(12) United States Patent
Zhang et al.

(10) Patent No.: US 11,447,758 B2
(45) Date of Patent: Sep. 20, 2022

(54) **PROTEIN MUTANTS THAT ENHANCE THE DNA CLEAVAGE ACTIVITY OF *ACIDAMINOCOCCUS* SP. CPF1**

(71) Applicant: Integrated DNA Technologies, Inc., Coralville, IA (US)

(72) Inventors: Liyang Zhang, Coralville, IA (US); Christopher Anthony Vakulskas, North Liberty, IA (US); Nicole Mary Bode, Oxford, IA (US); Michael Allen Collingwood, North Liberty, IA (US); Kristin Renee Beltz, Cedar Rapids, IA (US); Mark Aaron Behlke, Coralville, IA (US)

(73) Assignee: INTEGRATED DNA TECHNOLOGIES, INC., Coralville, IA (US)

( * ) Notice: Subject to any disclaimer, the term of this patent is extended or adjusted under 35 U.S.C. 154(b) by 0 days.

(21) Appl. No.: 16/536,256

(22) Filed: Aug. 8, 2019

(65) Prior Publication Data

US 2020/0109382 A1    Apr. 9, 2020

Related U.S. Application Data

(60) Provisional application No. 62/870,268, filed on Jul. 3, 2019, provisional application No. 62/749,607, filed on Oct. 23, 2018, provisional application No. 62/716,138, filed on Aug. 8, 2018.

(51) Int. Cl.
    *C12N 9/22*     (2006.01)
    *C12N 15/11*    (2006.01)

(52) U.S. Cl.
    CPC .............. *C12N 9/22* (2013.01); *C12N 15/11* (2013.01); *C12N 2310/20* (2017.05); *C12N 2800/80* (2013.01)

(58) Field of Classification Search
    CPC ...... C12N 9/22; C12N 15/11; C12N 2310/20; C12N 2800/80; C12N 15/113
    See application file for complete search history.

(56) References Cited

U.S. PATENT DOCUMENTS

2017/0233756 A1* 8/2017 Begemann ............... C12N 9/22
                                                        800/295

FOREIGN PATENT DOCUMENTS

| WO | 2017/189308 A1 | | 2/2017 |
| WO | 2018/035388 A1 | | 2/2018 |
| WO | WO 2018/098383 | * | 5/2018 |
| WO | 2019/178426 A1 | | 9/2019 |

OTHER PUBLICATIONS

Witkowski et al., Biochemistry 38:11643-11650, 1999.*
Tang et al., Phil Trans R Soc B 368:20120318, 1-10, 2013.*
Seffernick et al., J. Bacteriol. 183(8):2405-2410, 2001.*
Sadowski et al., Current Opinion in Structural Biology 19:357-362, 2009.*
Branden et al., Introduction to Protein Structure, Garland Publishing Inc., New York, p. 247, 1991.*
International Search Report and Written Opinion from corresponding International Patent Application No. PCT/US2019/045813 dated Jan. 8, 2020, 13 pages.
Zetsche et al. "Cpf1 is a Single RNA-Guided Endonuclease of a Class 2 CRISPR-Cas System," Cell, 2015, 759-771.
Li et al. "Design and Assessment of Engineered CRISPR-Cpf1 and Its Use for Genome Editing," Nature Protocols, 2018, 899-914.
Stella et al. "Structure of the Cpf1 Endonuclease R-loop complex After Target DNA Cleavage," Nature, 2017, 559-563.
Doench et al. "Rational Design of Highly Active sgRNAs for CRISPPR-Cas9-mediated Gene Inactivation," Nature Biotechnology, 2014, 1262-1267.

* cited by examiner

*Primary Examiner* — Delia M Ramirez
(74) *Attorney, Agent, or Firm* — Klintworth & Rozenblat IP LLP

(57) ABSTRACT

The present disclosure concerns polynucleotides and amino acids of *Acidaminococcus* sp. Cas12a (Cpf1) and methods for their use for genome editing in eukaryotic cells.

13 Claims, 23 Drawing Sheets

Specification includes a Sequence Listing.

HPRT38346, TTTT PAM

HPRT38346, TTTT PAM

Survived

Input

HPRT38346, TTTT PAM

Input

Survived

PROTEIN MUTANTS THAT ENHANCE THE DNA CLEAVAGE ACTIVITY OF *ACIDAMINOCOCCUS* SP. CPF1

CROSS-REFERENCE TO RELATED APPLICATIONS

This application claims benefit of priority under 35 U.S.C. 119 to U.S. Provisional Patent Application Ser. No. 62/870,268, filed Jul. 3, 2019 and entitled "OPTIMIZED CAS12A (CPF1) PROTEINS FOR EFFICIENT GENOME EDITING IN EUKARYOTIC CELLS," U.S. Provisional Patent Application Ser. No. 62/749,607, filed Oct. 23, 2018 and entitled "DEEP-SCANNING MUTAGENESIS UNCOVERS NOVEL MUTATIONS THAT ENHANCE THE DNA CLEAVAGE ACTIVITY OF *ACIDAMINOCOCCUS* SP. CAS12A/CAS12A AT NON-CANONICAL TTTT PAM SITES" and U.S. Provisional Patent Application Ser. No. 62/716,138, filed Aug. 8, 2018 and entitled "NOVEL MUTATIONS THAT ENHANCE THE DNA CLEAVAGE ACTIVITY OF *ACIDAMINOCOCCUS* SP. CPF1," the contents of each application are herein incorporated by reference in its entirety.

FIELD OF THE INVENTION

This invention pertains to the ability to cleave double-stranded DNA of living organisms at precise positions with the CRISPR/Cas12a (Cpf1) nuclease system. In particular, a series of recombinant Cas12a proteins are described that are useful in a eukaryotic cell context.

SEQUENCE LISTING

The instant application contains a Sequence Listing that has been submitted in ASCII format via EFS-Web and is hereby incorporated by reference in its entirety. The ASCII copy, created on Apr. 7, 2022, is named IDT01-013-PCT_Corrected_ST25.txt, and is 2,548,610 bytes in size.

BACKGROUND OF THE INVENTION

Cas12a is an RNA-guided endonuclease found in bacterial species including *Acidaminococcus* sp. and is part of the Clustered Regularly Interspaced Short Palindromic Repeat (CRISPR) adaptive immune system. Cas12a is guided to a 21~24-nt DNA target sequence, or commonly referred as protospacer, by a target site-specific 21~24-nt complementary RNA. The Cas12a-gRNA ribonucleoprotein (RNP) complex mediates double-stranded DNA breaks (DSBs), which are then repaired by either the non-homologous end joining (NHEJ, typically introduces mutations or indels at the cut site), or the homology directed repair (HDR) system for precise editing if a suitable template nucleic acid is present.

Critical to the recognition of correct DNA target for Cas12a includes both crRNA and the canonical "TTTV" protospacer adjacent motif (PAM), which is a 4-bp sequence immediately upstream of the protospacer. Compared to the 2-bp NGG PAM of Cas9 from *Streptococcus pyogenes*, Cas12a expanded the targetable loci in genome editing, particularly over the AT-rich sites that are inaccessible to the Cas9 system. However, due to its relatively low enzymatic activity, the likelihood that efficient genome editing can be achieved for a given site is much lower than that of the Cas9 system, which restricts its broader application. As the consequence, the Cas12a system is frequently considered as an alternative approach only when the genomic site is not targetable by Cas9.

Protein engineering by mutagenesis can alter the preference of PAM sequence of CRISPR system. Through a structural-guided mutagenic screening of residues in proximity of PAM sequence, previous study has identified two AsCpf1 variants that are compatible with TYCV and TATV PAMs, respectively. Although these variants collectively expanded the targetable sites of Cpf1 system over the coding region of the human genome by 3-fold, the utility of each individual variant is still limited, due to their mutually exclusive requirement of PAM sequences (TYCV vs TATV vs TTTV). Identifying Cpf1 variants with shorter PAM and greater sequence flexibility without sacrificing the activity at canonical PAM sites is highly desirable.

Thus, there is a need to enhance the utility of Cas12a. One aspect of the present application is to enhance the utility of Cpf1 by broadening its PAM compatibility. In this regard, certain novel AsCas12a variants with enhanced activity have been discovered. Another desired objective is to maximize delivery of the bacterial protein to the eukaryotic nucleus while simultaneously avoiding disruption of basic Cas12a function. Since the Cas12a is a bacterial protein, certain molecular genetic obstacles must first be overcome before one can achieve successful delivery of the protein to eukaryotic cells. This invention provides unique solutions to achieving these objectives.

BRIEF SUMMARY OF THE INVENTION

In a first aspect, A CRISPR-associated protein comprising a polypeptide encoding a variant of AsCpf1 is provided. The variant of AsCpf1 is selected from the group consisting of M537R (SEQ ID NO.: 472), F870L (SEQ ID NO.: 473), and M537R/F870L (SEQ ID NO.: 465).

In a second aspect, a CRISPR ribonucleoprotein complex is provided. The CRISPR ribonucleoprotein complex includes a guide RNA and a CRISPR-associated protein. The CRISPR-associated protein including a polypeptide encoding a variant of AsCpf1. The variant of AsCpf1 is selected from the group consisting of M537R (SEQ ID NO.: 472), F870L (SEQ ID NO.: 473), and M537R/F870L (SEQ ID NO.: 465).

In a third aspect, a method of increasing efficiency of gene editing at TTTN PAM sites in a cell with a CRISPR ribonucleoprotein complex is provided. The method includes the step of contacting a cell with the CRISPR ribonucleoprotein complex. The CRISPR ribonucleoprotein complex includes a guide RNA and a CRISPR-associated protein. The CRISPR-associated protein including a polypeptide encoding a variant of AsCpf1. The variant of AsCpf1 is selected from the group consisting of M537R (SEQ ID NO.: 472), F870L (SEQ ID NO.: 473), and M537R/F870L (SEQ ID NO.: 465).

In a fourth aspect, a kit comprising a guide RNA and a CRISPR-associated protein is provided. The CRISPR-associated protein includes a polypeptide encoding a variant of AsCpf1.

In a fifth aspect, CRISPR-associated protein comprising a polypeptide encoding a variant of AsCas12a, wherein the variant of AsCas12a is selected from the group consisting of at least one variant amino acid selected from amino acid positions 499-640 and 840-913, provided that the variant AsCas12a provides an improvement in CRISPR/AsCas12a-associated nuclease activity at non-canonical TTTT PAM sites.

In a sixth aspect, a CRISPR ribonucleoprotein complex is provided. The CRISPR ribonucleoprotein complex includes a guide RNA and a CRISPR-associated protein. The CRISPR-associated protein includes a polypeptide encoding a variant of AsCas12a, wherein the variant of AsCas12a is selected from the group consisting of at least one variant amino acid selected from amino acid positions 499-640 and 840-913, provided that the variant AsCas12a provides an improvement in CRISPR/AsCas12a-associated nuclease activity at non-canonical TTTT PAM sites.

In a seventh aspect, a method of increasing efficiency of gene editing at non-canonical TTTT PAM sites in a cell with a CRISPR ribonucleoprotein complex is provided. The method includes a step of contacting a cell with the CRISPR ribonucleoprotein complex that includes a guide RNA and a CRISPR-associated protein. The CRISPR-associated protein includes a polypeptide encoding a variant of AsCas12a, wherein the variant of AsCas12a is selected from the group consisting of at least one variant amino acid selected from amino acid positions 499-640 and 840-913, provided that the variant AsCas12a provides an improvement in CRISPR/AsCas12a-associated nuclease activity at non-canonical TTTT PAM sites.

In an eighth aspect, a kit including a guide RNA and a CRISPR-associated protein comprising a polypeptide encoding a variant of AsCas12a is provided. The variant of AsCas12a is selected from the group consisting of at least one variant amino acid selected from amino acid positions 499-640 and 840-913, provided that the variant AsCas12a provides an improvement in CRISPR/AsCas12a-associated nuclease activity at non-canonical TTTT PAM sites.

In a ninth aspect, a nucleic acid encoding a CRISPR-associated protein comprising a polypeptide encoding a variant of AsCas12a is provided. The variant of AsCas12a is selected from the group consisting of at least one variant amino acid selected from amino acid positions 499-640 and 840-913, provided that the variant AsCas12a provides an improvement in CRISPR/AsCas12a-associated nuclease activity at non-canonical TTTT PAM sites.

In a tenth aspect, a polynucleotide sequence encoding a Cas12a polypeptide is provided. The polynucleotide sequence includes one member selected from the group consisting of SEQ ID NOs.: 5-17.

In an eleventh aspect, an amino acid sequence encoding a Cas12a polypeptide is provided. The amino acid sequence includes one member selected from the group consisting of SEQ ID NOs.: 18-30.

In a twelfth aspect, a CAS endonuclease system comprising an expression cassette encoding a polynucleotide sequence encoding a Cas12a polypeptide is provided. The includes one member selected from the group consisting of SEQ ID NOs.: 5-17.

In a thirteenth aspect, CAS endonuclease system comprising an amino acid sequence encoding a Cas12a polypeptide is provided The amino acid sequence includes one member selected from the group consisting of SEQ ID NOs.: 18-30.

In a fourteenth aspect, a method of performing genome editing in a eukaryotic cells is provided. The method includes the step of introducing an CAS endonuclease system into the eukaryotic cell, said CAS endonuclease system comprising an expression cassette encoding a polynucleotide sequence encoding a Cas12a polypeptide, comprising one member selected from the group consisting of SEQ ID NOs.: 5-17.

In a fifteenth aspect, a method of performing genome editing in a eukaryotic cell is provided. The method includes the step of introducing an CAS endonuclease system into the eukaryotic cell, said CAS endonuclease system comprising an amino acid sequence encoding a Cas12a polypeptide comprising one member selected from the group consisting of SEQ ID NOs.: 18-30.

In a sixteenth aspect, an CRISPR-associated protein comprising a fusion polypeptide is provided. The fusion polypeptide includes an AsCas12a open reading frame, a nuclear localization signal, optionally an amino acid linker and optionally an affinity tag.

In a seventeenth aspect, a method of performing genome editing in a eukaryotic cell is provided. The method includes the step of introducing an CAS endonuclease system into the eukaryotic cell, said CAS endonuclease system comprising a CRISPR-associated protein of according to the sixteenth aspect.

BRIEF DESCRIPTION OF THE DRAWINGS

FIGS. 5D and 5E show that M537R and F870L are the optimal substitutions at respective positions, which is consistent with the result of our previous screening and mutant characterization.

DETAILED DESCRIPTION

Figure 1:
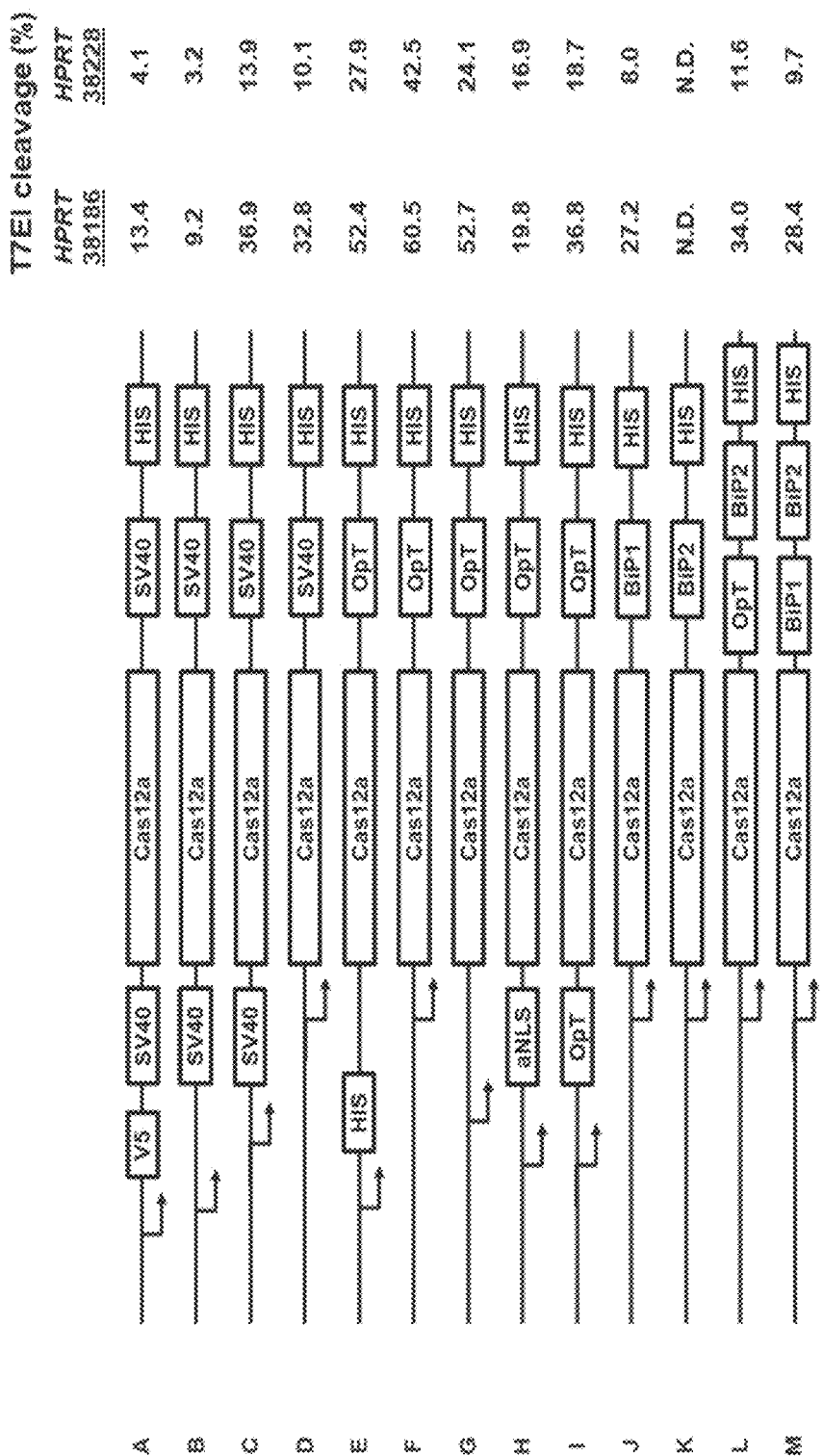
FIG. 1 depicts multiple recombinant forms of Cas12a yields a spectrum of editing efficiencies. A series of recombinant Cas12a proteins with differing composition and arrangement of NLS sequences, purification tags, and linkers (A-M; corresponding to SEQ ID NOs.:18-30) were cloned and purified to homogeneity. The resulting purified Cas12a derivatives were delivered into HEK293 cells by electroporation complexed to RNA guides that target the HPRT-38186 (SEQ ID NO.:1) and HPRT-38228 loci (SEQ ID NO.:2). DNA was isolated from genome editing experiments 48 hr later, and editing efficiencies were determined by PCR amplification of edited loci using HPRT-FWD (SEQ ID NO.:3) and HPRT-REV (SEQ ID NO.:4) primers and the Alt-R Genome Editing Detection Kit (Integrated DNA Technologies). The following abbreviations apply for the illustrated constructs: V5 refers to V5 epitope tag (SEQ ID NO.: 485); SV40 refers to a nuclear localization signal from simian virus SV40 large tumor antigen (SEQ ID NO.: 475); Cas12a refers to a Cas12a coding sequence; HIS refers to a hexahistidine tag (SEQ ID NO.: 487); OpT refers to an optimized nuclear localization signal (SEQ ID NO.: 477); aNLS refers to an alternative nuclear localization signal (SEQ ID NO.: 479); BIP1 refers to a first bipartite nuclear localization signal (SEQ ID NO.: 481); and BIP2 refers to a second bipartite nuclear localization signal (SEQ ID NO.: 483). The arrows provided in the constructs depict transcriptional start sites for mRNA transcripts originating from the DNA.

The present invention concerns compositions of Cas12a variants and methods to enhance the utility of Cas12a and variants thereof for expression in eukaryotic cells.

Definitions

When introducing elements of aspects of the disclosure or particular embodiments, the articles "a," "an," "the," and "said" are intended to mean that there are one or more of the elements. The terms "comprising," "including," and "having" are intended to be inclusive and mean that there may be additional elements other than the listed elements. The term "or" means any one member of a particular list and also includes any combination of members of that list, unless otherwise specified.

As intended herein, the terms "substantially," "approximately," and "about" and similar terms are intended to have a broad meaning in harmony with the common and accepted usage in the art to which the subject matter of this disclosure pertains. It should be understood by those of skill in the art who review this disclosure that these terms are intended to allow a description of certain features described and claimed without restricting the scope of these features to precise numerical ranges provided. Accordingly, these terms should be interpreted as indicating that insubstantial or inconsequential modifications or alterations of the subject matter described and claimed are considered to be within the scope of the invention as recited in the appended claims.

Definitions pertaining to certain terms and phrases applicable herein may be found in related US patents and publications, such as U.S. patent application Ser. Nos. 14/975,709, 15/299,549, 15/299,590, 15/299,593, 15/881,684, 15/729,491, 15/821,736, 15/964,041, 15/839,817, 15/839,820, 62/716,138, and U.S. Pat. No. 9,840,702.

The term "substantially purified," as applied to a composition, refers to a composition having at least 90% purity or greater, including 90% purity, 95% purity, 99% purity and greater than 99% purity.

The adjective "isolated," when modifying a composition, such as a polynucleotide, a polypeptide or a ribonucleoprotein complex refers to a substantially purified composition, or in the case of a ribonucleoprotein complex, at least one component being a substantially purified component. In further respect to an isolated ribonucleoprotein complex, preferably all components are substantially purified.

The terms "nucleic acid" and "polynucleotide" are interchangeable have the same meaning.

The terms "amino acid sequence," "polypeptide," and "protein" are interchangeable have the same meaning.

The term "affinity tag" refers to a ligand that permits detection and/or selection of an oligonucleotide sequence to which the ligand is attached. For the purposes of this disclosure, a bait may include an affinity tag. In particular, the affinity tag is positioned typically at either or both the N'-terminus and/or C'-terminus of a polypeptide through the use of conventional chemical coupling technology or recombinant DNA technology. Exemplary affinity tags include biotin, digoxigenin, streptavidin, polyhistine (for example, ($His_6$),), glutathione-S-transferase (GST), HaloTag®, AviTag, Calmodulin-tag, polyglutamate tag, FLAG-tag, HA-tag, Myc-tag, S-tag, SBP-tag, Softag 3, V5 tag, Xpress tag, a hapten, among others.

The term "eukaryotic cell," includes those cells of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. Preferred human cells include cells derived from somatic cells and germ line cells. Exemplary somatic cells include cells from every major organ and tissue system, including the immune system and hematopoietic system.

As set forth herein, the Conditions 1, 2 and 3 refer to different combinations of background strain and the amounts of gRNA introduced in the background strain before selection of the variants. Condition 1 is a M537R/F870L background that includes an introduced amount of gRNA (100 pmol per 10 microliter transformation/plating experiment) in which variants were selected. Condition 2 is a M537R/F870L background that includes an introduced amount of gRNA (50 pmol per 10 microliter transformation/plating experiment) in which variants were selected. Condition 3 is a Wild-type AsCpf1 background that includes an introduced amount of gRNA (200 pmol per 10 microliter transformation/plating experiment) in which variants were selected.

Cas12a Polypeptides Having Eukaryotic Nuclear Localization Signals

Since Cas12a is a bacterial protein, it has no native targeting mechanism to reach the eukaryotic nucleus, where the target DNA resides.

To more efficiently target proteins to the eukaryotic nucleus, short protein sequences called nuclear localization signals (NLS) are commonly added to the amino- or carboxy-terminal ends of a given open reading frame. NLSs are recognized by import proteins on the eukaryotic nuclear envelope that first bind to the nuclear membrane, and subsequently permit pore translocation into the nucleus by an energy-dependent process. While recombinant protein tags like an NLS can greatly improve localization, any addition of exogenous amino acid sequences stands a reasonable chance of perturbing protein function. As such, discovering a recombinant Cas12a protein sequence that facilitates the highest amount of nuclear delivery without negatively affecting its activity will ultimately result in the most potent Cas12a genome editing solution, which is non-trivial and highly desirable.

To improve nuclear delivery of Cas12a without perturbing its function, several different recombinant versions of Cas12a were constructed in which the identity, location, and number of protein tags (NLS, hexahistidine tag (an exemplary affinity tag)) were varied. Whereas hexahistidine and V5 tags were added to Cas12a constructs to aid in protein purification and/or detection, the NLS tags were added to assist in delivery to the eukaryotic nucleus. Domain-breaking linker sequences were also varied in composition and location to empirically determine the best arrangement and context of tagged sequences. All constructs were first expressed in *E. coli*, and recombinant Cas12a proteins were purified with immobilized metal affinity chromatography (IMAC) followed by ion exchange chromatography as described previously.

AsCpf1 Polypeptide Variants Having Novel Cleavage Activities

Amino acid substitutions in AsCpf1 that enhance the cleavage activity at both canonical (TTTV) and non-canonical (TTTT) PAM sites using a bacterial screening approach are described. This screen contained two components: i) a toxin plasmid encoding an arabinose-inducible cell proliferation toxin and a CRISPR/Cpf1 on-target cleavage site (HPRT-38346) with TTTT PAM, and ii) a chloramphenicol resistance plasmid containing a randomly-mutagenized region within the AsCpf1 sequence (~5 mutations per kb). The screen was performed as follows: *E. coli* BW25141 (λDE3) was transformed with the toxin plasmid containing the HPRT-38346 target site in the absence of arabinose, where the toxin is not produced and cell survival is permitted. Cells with stably replicating toxin plasmid are then transformed with the AsCpf1 expression plasmid and crRNA targeting HPRT-38346, and then cells were plated on media containing both chloramphenicol and arabinose. Bacteria that grew were those that i) successfully transformed with the AsCpf1 expression plasmid, ii) expressed sufficient AsCpf1 variant to cleave the toxin plasmid at HPRT-38346 site using TTTT PAM. The AsCpf1 expression plasmids within the survived cells were recovered and used in the subsequent round of selection. After multiple rounds of selection, the identities of enriched AsCpf1 variants were determined by DNA sequencing, and carried forward for analysis in mammalian cells.

The disclosure provides following two novel point mutations and the combination in the AsCpf1 gene that enhances the cleavage activity: M537R and F870L. The cleavage activity of individual mutant was first tested in a bacterial-based activity assay. Next, purified proteins were further tested in vitro and in human cell lines. In summary, both substitutions significantly enhanced the DNA cleavage activity of Cpf1 at TTTT PAM sites in all assays. Further, the combination of M537R and F870L broadly enhanced the targeting efficiency of AsCpf1 in human cell line. Overall, the present invention identifies novel amino-acid positions in the AsCpf1 gene that can be mutated to improve its cleavage activity at all TTTN (N=A/G/C/T) PAM sites.

As explained in the Background section, the prior art consists of using wild-type Cpf1 protein or two variants that are compatible with TYCV and TATV PAMs. As stated previously, these variants have limited utility due to the complex and mutually exclusive requirement of PAM sequence. Further, none of the variants showed any improved cleavage activity at TTTT PAM, which is unfortunately more frequent than other TTTV PAM sites (V=G/A/C) throughout the human genome. In contrast, not only enabling efficient cleavage at TTTT PAM, the mutations reported in this invention (M537R and F870L) broadly enhanced the cleavage activity of Cpf1 at canonical TTTV sites tested in human cell line. Together, the enhanced activity and broadened PAM flexibility (TTTN) of this invention makes it a superior CRISPR enzyme, which could directly replace the current wild-type Cpf1 in the application genomic editing.

High-Throughput Generation of AsCas12a Variants Having Cleavage Activity Towards a TTTT PAM-Containing Target Site.

The phenotype of all point mutations in the following regions of AsCas12a: 499-640 and 840-913 in the bacterial screening measuring the DNA cleavage activity at non-canonical TTTT PAM is described. Three sets of screening were performed to measure the phenotype of each point mutation, in the background of both WT-AsCas12a and M537R/F870L-AsCas12a. Cross-comparison of three datasets revealed consistent phenotype measurements, which enabled us to isolate novel AsCas12a variants with enhanced activity beyond M537R and F870L.

The high-throughput characterization of Cas12a activity at a TTTT PAM site provided the functional consequence of every possible single amino acid change within targeted region. The unbiased strategy of the present invention enables one to identify a large collection of mutants to further enhance the cleavage activity of AsCas12a over our previous invention (M537R/F870L).

To improve the coverage and efficiency of the screening, we generated an AsCas12a deep-scanning mutagenesis library containing all possible point mutations on the protein level in the targeted regions (490-640 and 840-913), with most clones contain only one mutation. This type of library allowed us to directly evaluate the phenotype of each point mutation, by measuring their relative survival rates over the reference protein in the bacterial screen. Briefly, the screening strain harboring the toxin plasmid was transformed with AsCas12a library with TTTT PAM-containing target site on the toxin plasmid. After transformation, cells were plated on selective media. AsCas12a expression plasmids carried by the survived E. coli cells were extracted and purified. Both input and selected plasmid libraries were PCR amplified, and sequenced on Illumina MiSeq with 1~2 million reads per library. The frequencies of each AsCas12a variant in both libraries were determined using Enrich 2, and normalized to the reference protein (WT or M537R/F870L). The relative survival rate of each point mutation over reference was calculated as the ratio of normalized frequency between selected and input library. Since the degree of cell survival is indicative of the DNA cleavage activity of each AsCas12a variant, any variants with higher survival rate than the reference protein would be those with enhanced activity at TTTT PAM.

As presented herein, codon-optimized Cas12a polypeptides are provided, including codon-optimized Cas12a polypeptides for CRISPR ribonucleoprotein complexes. An example of a codon-optimized sequence, is in this instance a sequence optimized for expression in eukaryotes, e.g., humans (i.e., being optimized for expression in humans), or for another eukaryote, animal or mammal as herein discussed. Whilst this is preferred, it will be appreciated that other examples are possible and codon optimization for a host species other than human, or for codon optimization for specific organs is known. In some embodiments, an enzyme coding sequence encoding a CRISPR Cas12a polypeptide is a codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded.

Preferred human cells include cells derived from somatic cells and germ line cells. Exemplary somatic cells include cells from every major organ and tissue system, including the immune system and hematopoietic system.

In general, codon optimization refers to a process of modifying a nucleic acid sequence for enhanced expression in the host cells of interest by replacing at least one codon (e.g. about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, Pa.), are also available. In some embodiments, one or more codons (e.g. 1, 2, 3, 4, 5, 10, 15, 20, 25, 50, or more, or all codons) in a sequence encoding a Cas12a correspond to the most frequently used codon for a particular amino acid.

Additionally, codon-optimized Cas12a polypeptides are provided, including codon-optimized Cas12a polypeptides for CRISPR ribonucleoprotein complexes, wherein the Cas12a polypeptide sequence optimized for expression in prokaryotes, such as bacteria (e.g., *E. coli*).

Applications

This invention is useful for either basic research or therapeutic fields for any CRISPR/Cas12a DNA cleavage and/or gene editing experiments or treatments. The superior activity of these recombinant variants could be applied to Cas12a from any species or potentially any CRISPR enzyme.

In a first aspect, A CRISPR-associated protein comprising a polypeptide encoding a variant of AsCpf1 is provided. The variant of AsCpf1 is selected from the group consisting of M537R (SEQ ID NO.: 472), F870L (SEQ ID NO.: 473), and M537R/F870L (SEQ ID NO.: 465). In a first respect, the CRISPR-associated protein corresponds to a variant of AsCpf1 is M537R. In a second respect, the CRISPR-associated protein corresponds to a variant of AsCpf1 is F870L (SEQ ID NO.: 473). In a third respect, the CRISPR-associated protein corresponds to a variant of AsCpf1 is M537R/F870L (SEQ ID NO.: 465).

In a second aspect, a CRISPR ribonucleoprotein complex is provided. The CRISPR ribonucleoprotein complex includes a guide RNA and a CRISPR-associated protein. The CRISPR-associated protein including a polypeptide encoding a variant of AsCpf1. The variant of AsCpf1 is selected from the group consisting of M537R (SEQ ID NO.: 472), F870L (SEQ ID NO.: 473), and M537R/F870L (SEQ ID NO.: 465). In a first respect, the CRISPR ribonucleoprotein complex includes the variant of AsCpf1 being M537R. In a second respect, the CRISPR ribonucleoprotein complex includes the variant of AsCpf1 being F870L (SEQ ID NO.: 473). In a third respect, the CRISPR ribonucleoprotein complex includes the variant of AsCpf1 being M537R/F870L (SEQ ID NO.: 465).

In a third aspect, a method of increasing efficiency of gene editing at TTTN PAM sites in a cell with a CRISPR ribonucleoprotein complex is provided. The method includes the step of contacting a cell with the CRISPR ribonucleoprotein complex. The CRISPR ribonucleoprotein complex includes a guide RNA and a CRISPR-associated protein. The CRISPR-associated protein including a polypeptide encoding a variant of AsCpf1. The variant of AsCpf1 is selected from the group consisting of M537R (SEQ ID NO.: 472), F870L (SEQ ID NO.: 473) and M537R/F870L (SEQ ID NO.: 465). In a first respect, the TTTN PAM sites consists of one selected form the group of TTTA, TTTT and TTTC PAM sites.

In a fourth aspect, a kit includes a guide RNA and a CRISPR-associated protein is provided. The CRISPR-associated protein includes a polypeptide encoding a variant of AsCpf1. The variant of AsCpf1 is selected from the group consisting of M537R (SEQ ID NO.: 472), F870L (SEQ ID NO.: 473), and M537R/F870L (SEQ ID NO.: 465). In a first respect, the variant of AsCpf1 is M537R. In a second respect, the variant of AsCpf1 is F870L (SEQ ID NO.: 473). In a third respect, the variant of AsCpf1 is M537R/F870L (SEQ ID NO.: 465).

In a fifth aspect, a CRISPR-associated protein comprising a polypeptide encoding a variant of AsCas12a, wherein the variant of AsCas12a is selected from the group consisting of at least one variant amino acid selected from amino acid positions 499-640 and 840-913, provided that the variant AsCas12a provides an improvement in CRISPR/AsCas12a-associated nuclease activity at non-canonical TTTT PAM sites. In a first respect, the variant of AsCas12a is selected from the group consisting of SEQ ID NOs.: 59-245. In a second respect, the variant of AsCas12a, as described in the first aspect or the foregoing first respect of the first aspect, further comprises mutations of M537R/F870L (SEQ ID NO.: 465).

In a sixth aspect, a CRISPR ribonucleoprotein complex is provided. The CRISPR ribonucleoprotein complex includes a guide RNA and a CRISPR-associated protein. The CRISPR-associated protein includes a polypeptide encoding a variant of AsCas12a, wherein the variant of AsCas12a is selected from the group consisting of at least one variant amino acid selected from amino acid positions 499-640 and 840-913, provided that the variant AsCas12a provides an improvement in CRISPR/AsCas12a-associated nuclease activity at non-canonical TTTT PAM sites. In a first respect, the variant of AsCas12a is selected from the group consisting of SEQ ID NOs.: 59-245. In a second respect, the variant of AsCas12a, as described in the second aspect or the foregoing first respect of the second aspect, further comprises mutations of M537R/F870L (SEQ ID NO.: 465).

In a seventh aspect, a method of increasing efficiency of gene editing at non-canonical TTTT PAM sites in a cell with a CRISPR ribonucleoprotein complex is provided. The method includes a step of contacting a cell with the CRISPR ribonucleoprotein complex that includes a guide RNA and a CRISPR-associated protein. The CRISPR-associated protein includes a polypeptide encoding a variant of AsCas12a, wherein the variant of AsCas12a is selected from the group consisting of at least one variant amino acid selected from amino acid positions 499-640 and 840-913, provided that the variant AsCas12a provides an improvement in CRISPR/AsCas12a-associated nuclease activity at non-canonical TTTT PAM sites. In a first respect, the variant of AsCas12a is selected from the group consisting of SEQ ID NOs.: 59-245. In a second respect, the variant of AsCas12a, as described in the third aspect or the foregoing first respect of the third aspect, further comprises mutations of M537R/F870L (SEQ ID NO.: 465).

In an eighth aspect, a kit including a guide RNA and a CRISPR-associated protein comprising a polypeptide encoding a variant of AsCas12a is provided. The variant of AsCas12a is selected from the group consisting of at least one variant amino acid selected from amino acid positions 499-640 and 840-913, provided that the variant AsCas12a provides an improvement in CRISPR/AsCas12a-associated nuclease activity at non-canonical TTTT PAM sites. In a first respect, the variant of AsCas12a is selected from the group consisting of SEQ ID NOs.: 59-245. In a second respect, the variant of AsCas12a, as described in the fourth aspect or the foregoing first respect of the fourth aspect, further comprises mutations of M537R/F870L (SEQ ID NO.: 465).

In a ninth aspect, a nucleic acid encoding a CRISPR-associated protein comprising a polypeptide encoding a variant of AsCas12a is provided. The variant of AsCas12a is selected from the group consisting of at least one variant amino acid selected from amino acid positions 499-640 and 840-913, provided that the variant AsCas12a provides an improvement in CRISPR/AsCas12a-associated nuclease activity at non-canonical TTTT PAM sites. Highly preferred nucleic acids encoding a CRISPR-associated protein include isolated nucleic acids encoding a CRISPR-associated protein. In a first respect, the variant of AsCas12a is selected from the group consisting of SEQ ID NOs.: 59-245. In a second respect, the variant of AsCas12a further includes mutations of M537R/F870L (SEQ ID NO.: 465). In a third respect, the nucleic acid is operably linked to suitable transcription elements to express the nucleic acid. In a fourth respect, the nucleic acid is DNA or RNA.

In a tenth aspect, a polynucleotide sequence encoding a Cas12a polypeptide is provided. The polynucleotide sequence includes one member selected from the group consisting of SEQ ID NOs.: 5-17.

In an eleventh aspect, an amino acid sequence encoding a Cas12a polypeptide is provided. The amino acid sequence includes one member selected from the group consisting of SEQ ID NOs.: 18-30.

In a twelfth aspect, a CAS endonuclease system comprising an expression cassette encoding a polynucleotide sequence encoding a Cas12a polypeptide is provided. The includes one member selected from the group consisting of SEQ ID NOs.: 5-17.

In a thirteenth aspect, CAS endonuclease system comprising an amino acid sequence encoding a Cas12a polypeptide is provided The amino acid sequence includes one member selected from the group consisting of SEQ ID NOs.: 18-30.

In a fourteenth aspect, a method of performing genome editing in a eukaryotic cells is provided. The method includes the step of introducing an CAS endonuclease system into the eukaryotic cell, said CAS endonuclease system comprising an expression cassette encoding a polynucleotide sequence encoding a Cas12a polypeptide, comprising one member selected from the group consisting of SEQ ID NOs.: 5-17.

In a fifteenth aspect, a method of performing genome editing in a eukaryotic cell is provided. The method includes the step of introducing an CAS endonuclease system into the eukaryotic cell, said CAS endonuclease system comprising an amino acid sequence encoding a Cas12a polypeptide comprising one member selected from the group consisting of SEQ ID NOs.: 18-30.

In a sixteenth aspect, an CRISPR-associated protein comprising a fusion polypeptide is provided. The fusion polypeptide includes an AsCas12a open reading frame, a nuclear localization signal, optionally an amino acid linker and optionally an affinity tag. Highly preferred CRISPR-associated proteins include isolated CRISPR-associated proteins. In a first respect, the AsCas12a open reading frame is selected from the group consisting of SEQ ID NOs.: 59-245. In a second respect, the nuclear localization signal is selected from SEQ ID NOs.: 475, 477, 479, 481 and 483. In a third respect, the CRISPR-associated protein is encoded by SEQ ID NOs.: 488-491. In a fourth respect, the CRISPR-associated protein is selected from SEQ ID NOs.: 492 and 493.

In a seventeenth aspect, a method of performing genome editing in a eukaryotic cell is provided. The method includes the step of introducing an CAS endonuclease system into the eukaryotic cell, said CAS endonuclease system comprising an CRISPR-associated protein of according to the sixteenth aspect. Highly preferred CRISPR-associated proteins include isolated CRISPR-associated proteins.

EXAMPLES

Example 1

Recombinant Cas12a Proteins with Varying Tags/Linker Sequences Yield a Spectrum of Editing Efficiencies The following Example demonstrates that recombinant Cas12a proteins with only modest changes in tag sequences at the amino- and carboxy-termini results in proteins that demonstrate a wide range of editing efficiencies in human cells (FIG. 1).

Briefly, the method of site directed mutagenesis (SDM) was employed to create the expression constructs having As Cas12a coding sequences with different nuclear localization signals (NLS's). Site directed mutagenesis was performed by designing complimentary primers that encompass the desired nucleotide base change(s), along with flanking plasmid vector sequence, wherein each flanking region has a melting temperature ($T_m$) of at least 60° C. A polymerase chain reaction (PCR) run was then performed using standard cycling conditions for a total of 16 cycles. The restriction enzyme, DPN I, was added to digest away the starting plasmid vector material so only the new product containing the base changes remain. After DPN I treatment, a small amount of the PCR product was transformed into competent E. coli cells, recovered in SOC media and plated onto kanamycin resistance Luria Broth (LB) agar plates. Colonies were screened using the Sanger sequencing method to verify correct base changes in selected clones.

The results indicate that the ideal sequence and placement of NLS sequences on Cas12a is not obvious, and that a highly efficient Cas12a genome editing solution must be empirically determined as was done in this study. Proteins were tested using guides that target the HPRT-38186 (SEQ ID NO.:1) and HPRT-38228 (SEQ ID NO.:2) loci in human cells. SEQ ID NOs.: 1-4 are depicted in Table 1.

TABLE 1

Sequence of oligonucleotides used as crRNAs or PCR primers.

| Name | Sequence | SEQ ID NO. |
|---|---|---|
| HPRT-38186-S | rUrArArUrUrUrCrUrArCrUrCrUrUr GrUrArGrArUrUrArArUrGrCrCr CrUrGrUrArGrUrCrUrCrUrCrUrG | SEQ ID NO. 1 |
| HPRT-38228-S | rUrArArUrUrUrCrUrArCrUrCrUrUr UrGrUrArGrArUrUrArArArUrUrArAr CrArGrCrUrUrGrCrUrGrGrUrGrA | SEQ ID NO. 2 |
| HPRT-FWD | AAGAATGTTGTGATAAAAGGTGATGCT | SEQ ID NO. 3 |
| HPRT-REV | GAGGCAGAAGTCCCATGGATGTGT | SEQ ID NO. 4 |

The following nucleotide sequences that encode preferred Cas12a polypeptides of this Example are depicted below:

SEQ ID NO.: 5

ATGGGCAGCAGCAGCAGCGGCCTGGTGCCGCGCGGCAGCCATATGGCTAGCATGACTGGT

GGACAGCAAATGGGTCGGGATCCAGGTAAACCGATTCCGAATCCGCTGCTGGGTCTGGATAGCACCGCACCG

AAAAAAAAACGTAAAGTTGGTATTCATGGTGTTCCGGCAGCAACCCAGTTTGAAGGTTTCACCAATCTGTATC

AGGTTAGCAAAACCCTGCGTTTTGAACTGATTCCGCAGGGTAAAACCCTGAAACATATTCAAGAACAGGGCTT

-continued

```
CATCGAAGAGGATAAAGCACGTAACGATCACTACAAAGAACTGAAACCGATTATCGACCGCATCTATAAAACC

TATGCAGATCAGTGTCTGCAGCTGGTTCAGCTGGATTGGGAAAATCTGAGCGCAGCAATTGATAGTTATCGCA

AAGAAAAAACCGAAGAAACCCGTAATGCACTGATTGAAGAACAGGCAACCTATCGTAATGCCATCCATGATT

ATTTCATTGGTCGTACCGATAATCTGACCGATGCAATTAACAAACGTCACGCCGAAATCTATAAAGGCCTGTTT

AAAGCCGAACTGTTTAATGGCAAAGTTCTGAAACAGCTGGGCACCGTTACCACCACCGAACATGAAATGCAC

TGCTGCGTAGCTTTGATAAATTCACCACCTATTTCAGCGGCTTTTATGAGAATCGCAAAAACGTGTTTAGCGCA

GAAGATATTAGCACCGCAATTCCGCATCGTATTGTGCAGGATAATTTCCCGAAATTCAAAGAGAACTGCCACA

TTTTTACCCGTCTGATTACCGCAGTTCCGAGCCTGCGTGAACATTTTGAAAACGTTAAAAAAGCCATCGGCATC

TTTGTTAGCACCAGCATTGAAGAAGTTTTTAGCTTCCCGTTTTACAATCAGCTGCTGACCCAGACCCAGATTGA

TCTGTATAACCAACTGCTGGGTGGTATTAGCCGTGAAGCAGGCACCGAAAAAATCAAAGGTCTGAATGAAGT

GCTGAATCTGGCCATTCAGAAAAATGATGAAACCGCACATATTATTGCAAGCCTGCCGCATCGTTTTATTCCGC

TGTTCAAACAAATTCTGAGCGATCGTAATACCCTGAGCTTTATTCTGGAAGAATTCAAATCCGATGAAGAGGT

GATTCAGAGCTTTTGCAAATACAAAACGCTGCTGCGCAATGAAAATGTTCTGGAAACTGCCGAAGCACTGTTT

AACGAACTGAATAGCATTGATCTGACCCACATCTTTATCAGCCACAAAAAACTGGAAACCATTTCAAGCGCACT

GTGTGATCATTGGGATACCCTGCGTAATGCCCTGTATGAACGTCGTATTAGCGAACTGACCGGTAAAATTACC

AAAAGCGCGAAAGAAAAAGTTCAGCGCAGTCTGAAACATGAGGATATTAATCTGCAAGAGATTATTAGCGCA

GCCGGTAAAGAACTGTCAGAAGCATTTAAACAGAAAACCAGCGAAATTCTGTCACATGCACATGCAGCACTG

GATCAGCCGCTGCCGACCACCCTGAAAAAACAAGAAGAAAAAGAAATCCTGAAAAGCCAGCTGGATAGCCTG

CTGGGTCTGTATCATCTGCTGGACTGGTTTGCAGTTGATGAAAGCAATGAAGTTGATCCGGAATTTAGCGCAC

GTCTGACCGGCATTAAACTGGAAATGGAACCGAGCCTGAGCTTTTATAACAAAGCCCGTAATTATGCCACCAA

AAAACCGTATAGCGTCGAAAAATTCAAACTGAACTTTCAGATGCCGACCCTGGCAAGCGGTTGGGATGTTAAT

AAAGAAAAAAACAACGGTGCCATCCTGTTCGTGAAAAATGGCCTGTATTATCTGGGTATTATGCCGAAACAGA

AAGGTCGTTATAAAGCGCTGAGCTTTGAACCGACGGAAAAAACCAGTGAAGGTTTTGATAAAATGTACTACG

ACTATTTTCCGGATGCAGCCAAAATGATTCCGAAATGTAGCACCCAGCTGAAAGCAGTTACCGCACATTTTCA

GACCCATACCACCCCGATTCTGCTGAGCAATAACTTTATTGAACCGCTGGAAATCACCAAAGAGATCTACGAT

CTGAATAACCCGGAAAAAGAGCCGAAAAAATTCCAGACCGCATATGCAAAAAAAACCGGTGATCAGAAAGGT

TATCGTGAAGCGCTGTGTAAATGGATTGATTTCACCCGTGATTTTCTGAGCAAATACACCAAAACCACCAGTAT

CGATCTGAGCAGCCTGCGTCCGAGCAGCCAGTATAAAGATCTGGGCGAATATTATGCAGAACTGAATCCGCT

GCTGTATCATATTAGCTTTCAGCGTATTGCCGAGAAAGAAATCATGGACGCAGTTGAAACCGGTAAACTGTAC

CTGTTCCAGATCTACAATAAAGATTTTGCCAAAGGCCATCATGGCAAACCGAATCTGCATACCCTGTATTGGAC

CGGTCTGTTTAGCCCTGAAAATCTGGCAAAAACCTCGATTAAACTGAATGGTCAGGCGGAACTGTTTTATCGT

CCGAAAAGCCGTATGAAACGTATGGCACATCGTCTGGGTGAAAAAATGCTGAACAAAAAACTGAAAGACCAG

AAAACCCCGATCCCGGATACACTGTATCAAGAACTGTATGATTATGTGAACCATCGTCTGAGCCATGATCTGA

GTGATGAAGCACGTGCCCTGCTGCCGAATGTTATTACCAAAGAAGTTAGCCACGAGATCATTAAAGATCGTCG

TTTTTACCAGCGACAAATTCTTTTTTCATGTGCCGATTACCCTGAATTATCAGGCAGCAAATAGCCCGAGCAAAT

TTAACCAGCGTGTTAATGCATATCTGAAAGAACATCCAGAAACGCCGATTATTGGTATTGATCGTGGTGAACG

TAACCTGATTTATATCACCGTTATTGATAGCACCGGCAAAATCCTGGAACAGCGTAGCCTGAATACCATTCAGC

AGTTTGATTACCAGAAAAAACTGGATAATCGCGAGAAAGAACGTGTTGCAGCACGTCAGGCATGGTCAGTTG

TTGGTACAATTAAAGACCTGAAACAGGGTTATCTGAGCCAGGTTATTCATGAAATTGTGGATCTGATGATTCA

CTATCAGGCCGTTGTTGTGCTGGAAAACCTGAATTTTGGCTTTAAAAGCAAACGTACCGGCATTGCAGAAAAA
```

-continued

GCAGTTTATCAGCAGTTCGAGAAAATGCTGATTGACAAACTGAATTGCCTGGTGCTGAAAGATTATCCGGCTG

AAAAAGTTGGTGGTGTTCTGAATCCGTATCAGCTGACCGATCAGTTTACCAGCTTTGCAAAAATGGGCACCCA

GAGCGGATTTCTGTTTTATGTTCCGGCACCGTATACGAGCAAAATTGATCCGCTGACCGGTTTTGTTGATCCGT

TTGTTTGGAAAACCATCAAAAACCATGAAAGCCGCAAACATTTTCTGGAAGGTTTCGATTTTCTGCATTACGAC

GTTAAAACGGGTGATTTCATCCTGCACTTTAAAATGAATCGCAATCTGAGTTTTCAGCGTGGCCTGCCTGGTTT

TATGCCTGCATGGGATATTGTGTTTGAGAAAAACGAAACACAGTTCGATGCAAAAGGCACCCCGTTTATTGCA

GGTAAACGTATTGTTCCGGTGATTGAAAATCATCGTTTCACCGGTCGTTATCGCGATCTGTATCCGGCAAATG

AACTGATCGCACTGCTGGAAGAGAAAGGTATTGTTTTTCGTGATGGCTCAAACATTCTGCCGAAACTGCTGGA

AAATGATGATAGCCATGCAATTGATACCATGGTTGCACTGATTCGTAGCGTTCTGCAGATGCGTAATAGCAAT

GCAGCAACCGGTGAAGATTACATTAATAGTCCGGTTCGTGATCTGAATGGTGTTTGTTTTGATAGCCGTTTTCA

GAATCCGGAATGGCCGATGGATGCAGATGCAAATGGTGCATATCATATTGCACTGAAAGGACAGCTGCTGCT

GAACCACCTGAAAGAAAGCAAAGATCTGAAACTGCAAAACGGCATTAGCAATCAGGATTGGCTGGCATATAT

CCAAGAACTGCGTAACCCTAAAAAAAAACGCAAAGTGAAGCTTGCGGCCGCACTCGAGCACCACCACCACCA

CCACTGA

SEQ ID NO.: 6
ATGGGCAGCAGCAGCAGCGGCCTGGTGCCGCGCGGCAGCCATATGGCTAGCATGACTGGT

GGACAGCAAATGGGTCGGGATCCAGCACCGAAAAAAAAACGTAAAGTTGGTATTCATGGTGTTCCGGCAGCA

ACCCAGTTTGAAGGTTTCACCAATCTGTATCAGGTTAGCAAAACCCTGCGTTTTGAACTGATTCCGCAGGGTAA

AACCCTGAAACATATTCAAGAACAGGGCTTCATCGAAGAGGATAAAGCACGTAACGATCACTACAAAGAACT

GAAACCGATTATCGACCGCATCTATAAAACCTATGCAGATCAGTGTCTGCAGCTGGTTCAGCTGGATTGGGAA

AATCTGAGCGCAGCAATTGATAGTTATCGCAAAGAAAAACCGAAGAAACCCGTAATGCACTGATTGAAGAA

CAGGCAACCTATCGTAATGCCATCCATGATTATTTCATTGGTCGTACCGATAATCTGACCGATGCAATTAACAA

ACGTCACGCCGAAATCTATAAAGGCCTGTTTAAAGCCGAACTGTTTAATGGCAAAGTTCTGAAACAGCTGGGC

ACCGTTACCACCACCGAACATGAAAATGCACTGCTGCGTAGCTTTGATAAATTCACCACCTATTTCAGCGGCTT

TTATGAGAATCGCAAAAACGTGTTTAGCGCAGAAGATATTAGCACCGCAATTCCGCATCGTATTGTGCAGGAT

AATTTCCCGAAATTCAAAGAGAACTGCCACATTTTTACCCGTCTGATTACCGCAGTTCCGAGCCTGCGTGAACA

TTTTGAAAACGTTAAAAAAGCCATCGGCATCTTTGTTAGCACCAGCATTGAAGAAGTTTTTAGCTTCCCGTTTT

ACAATCAGCTGCTGACCCAGACCCAGATTGATCTGTATAACCAACTGCTGGGTGGTATTAGCCGTGAAGCAGG

CACCGAAAAAATCAAAGGTCTGAATGAAGTGCTGAATCTGGCCATTCAGAAAAATGATGAAACCGCACATATT

ATTGCAAGCCTGCCGCATCGTTTTATTCCGCTGTTCAACAAATTCTGAGCGATCGTAATACCCTGAGCTTTATT

CTGGAAGAATTCAAATCCGATGAAGAGGTGATTCAGAGCTTTTGCAAATACAAAACGCTGCTGCGCAATGAA

AATGTTCTGGAAACTGCCGAAGCACTGTTTAACGAACTGAATAGCATTGATCTGACCCACATCTTTATCAGCCA

CAAAAAACTGGAAACCATTTCAAGCGCACTGTGTGATCATTGGGATACCCTGCGTAATGCCCTGTATGAACGT

CGTATTAGCGAACTGACCGGTAAAATTACCAAAGCGCGAAAGAAAAAGTTCAGCGCAGTCTGAAACATGAG

GATATTAATCTGCAAGAGATTATTAGCGCAGCCGGTAAGAACTGTCAGAAGCATTTAAACAGAAAACCAGC

GAAATTCTGTCACATGCACATGCAGCACTGGATCAGCCGCTGCCGACCACCCTGAAAAAACAAGAAGAAAAA

GAAATCCTGAAAAGCCAGCTGGATAGCCTGCTGGGTCTGTATCATCTGCTGGACTGGTTTGCAGTTGATGAAA

GCAATGAAGTTGATCCGGAATTTAGCGCACGTCTGACCGGCATTAAACTGGAAATGGAACCGAGCCTGAGCT

TTTATAACAAAGCCCGTAATTATGCCACCAAAAAACCGTATAGCGTCGAAAAATTCAAACTGAACTTTCAGATG

CCGACCCTGGCAAGCGGTTGGGATGTTAATAAAGAAAAAAACAACGGTGCCATCCTGTTCGTGAAAAATGGC

CTGTATTATCTGGGTATTATGCCGAAACAGAAAGGTCGTTATAAAGCGCTGAGCTTTGAACCGACGGAAAAA

-continued

ACCAGTGAAGGTTTTGATAAAATGTACTACGACTATTTTCCGGATGCAGCCAAAATGATTCCGAAATGTAGCA
CCCAGCTGAAAGCAGTTACCGCACATTTTCAGACCCATACCACCCCGATTCTGCTGAGCAATAACTTTATTGAA
CCGCTGGAAATCACCAAAGAGATCTACGATCTGAATAACCCGGAAAAAGAGCCGAAAAAATTCCAGACCGCA
TATGCAAAAAAAACCGGTGATCAGAAAGGTTATCGTGAAGCGCTGTGTAAATGGATTGATTTCACCCGTGATT
TTCTGAGCAAATACACCAAAACCACCAGTATCGATCTGAGCAGCCTGCGTCCGAGCAGCCAGTATAAAGATCT
GGGCGAATATTATGCAGAACTGAATCCGCTGCTGTATCATATTAGCTTTCAGCGTATTGCCGAGAAAGAAATC
ATGGACGCAGTTGAAACCGGTAAACTGTACCTGTTCCAGATCTACAATAAAGATTTTGCCAAAGGCCATCATG
GCAAACCGAATCTGCATACCCTGTATTGGACCGGTCTGTTTAGCCCTGAAAATCTGGCAAAAACCTCGATTAA
ACTGAATGGTCAGGCGGAACTGTTTTATCGTCCGAAAAGCCGTATGAAACGTATGGCACATCGTCTGGGTGA
AAAAATGCTGAACAAAAAACTGAAAGACCAGAAAACCCCGATCCCGGATACACTGTATCAAGAACTGTATGA
TTATGTGAACCATCGTCTGAGCCATGATCTGAGTGATGAAGCACGTGCCCTGCTGCCGAATGTTATTACCAAA
GAAGTTAGCCACGAGATCATTAAAGATCGTCGTTTTACCAGCGACAAATTCTTTTTTCATGTGCCGATTACCCT
GAATTATCAGGCAGCAAATAGCCCGAGCAAATTTAACCAGCGTGTTAATGCATATCTGAAAGAACATCCAGAA
ACGCCGATTATTGGTATTGATCGTGGTGAACGTAACCTGATTTATATCACCGTTATTGATAGCACCGGCAAAAT
CCTGGAACAGCGTAGCCTGAATACCATTCAGCAGTTTGATTACCAGAAAAAACTGGATAATCGCGAGAAAGA
ACGTGTTGCAGCACGTCAGGCATGGTCAGTTGTTGGTACAATTAAAGACCTGAAACAGGGTTATCTGAGCCA
GGTTATTCATGAAATTGTGGATCTGATGATTCACTATCAGGCCGTTGTTGTGCTGGAAAACCTGAATTTTGGCT
TTAAAAGCAAACGTACCGGCATTGCAGAAAAAGCAGTTTATCAGCAGTTCGAGAAAATGCTGATTGACAAACT
GAATTGCCTGGTGCTGAAAGATTATCCGGCTGAAAAAGTTGGTGGTGTTCTGAATCCGTATCAGCTGACCGAT
CAGTTTACCAGCTTTGCAAAAATGGGCACCCAGAGCGGATTTCTGTTTTATGTTCCGGCACCGTATACGAGCA
AAATTGATCCGCTGACCGGTTTTGTTGATCCGTTTGTTTGGAAAACCATCAAAAACCATGAAAGCCGCAAACA
TTTTCTGGAAGGTTTCGATTTTCTGCATTACGACGTTAAAACGGGTGATTTCATCCTGCACTTTAAAATGAATC
GCAATCTGAGTTTTCAGCGTGGCCTGCCTGGTTTTATGCCTGCATGGGATATTGTGTTTGAGAAAAACGAAAC
ACAGTTCGATGCAAAAGGCACCCCGTTTATTGCAGGTAAACGTATTGTTCCGGTGATTGAAAATCATCGTTTCA
CCGGTCGTTATCGCGATCTGTATCCGGCAAATGAACTGATCGCACTGCTGGAAGAGAAAGGTATTGTTTTTCG
TGATGGCTCAAACATTCTGCCGAAACTGCTGGAAAATGATGATAGCCATGCAATTGATACCATGGTTGCACTG
ATTCGTAGCGTTCTGCAGATGCGTAATAGCAATGCAGCAACCGGTGAAGATTACATTAATAGTCCGGTTCGTG
ATCTGAATGGTGTTTGTTTTGATAGCCGTTTTCAGAATCCGGAATGGCCGATGGATGCAGATGCAAATGGTGC
ATATCATATTGCACTGAAAGGACAGCTGCTGCTGAACCACCTGAAAGAAAGCAAAGATCTGAAACTGCAAAA
CGGCATTAGCAATCAGGATTGGCTGGCATATATCCAAGAACTGCGTAACCCTAAAAAAAAACGCAAAGTGAA
GCTTGCGGCCGCACTCGAGCACCACCACCACCACCACTGA

SEQ ID NO.: 7
ATGCCGAAAAAAAAACGCAAAGTGGGTATTCATGGTGTTCCGGCAGCAACCCAGTTTGAA
GGTTTCACCAATCTGTATCAGGTTAGCAAAACCCTGCGTTTTGAACTGATTCCGCAGGGTAAAACCCTGAAAC
ATATTCAAGAACAGGGCTTCATCGAAGAGGATAAAGCACGTAACGATCACTACAAAGAACTGAAACCGATTA
TCGACCGCATCTATAAAACCTATGCAGATCAGTGTCTGCAGCTGGTTCAGCTGGATTGGGAAAATCTGAGCGC
AGCAATTGATAGTTATCGCAAAGAAAAAACCGAAGAAACCCGTAATGCACTGATTGAAGAACAGGCAACCTA
TCGTAATGCCATCCATGATTATTTCATTGGTCGTACCGATAATCTGACCGATGCAATTAACAAACGTCACGCCG
AAATCTATAAAGGCCTGTTTAAAGCCGAACTGTTTAATGGCAAAGTTCTGAAACAGCTGGGCACCGTTACCAC
CACCGAACATGAAAATGCACTGCTGCGTAGCTTTGATAAATTCACCACCTATTTCAGCGGCTTTTATGAGAATC
GCAAAAACGTGTTTAGCGCAGAAGATATTAGCACCGCAATTCCGCATCGTATTGTGCAGGATAATTTCCCGAA

-continued

```
ATTCAAAGAGAACTGCCACATTTTTACCCGTCTGATTACCGCAGTTCCGAGCCTGCGTGAACATTTTGAAAACG

TTAAAAAAGCCATCGGCATCTTTGTTAGCACCAGCATTGAAGAAGTTTTTAGCTTCCCGTTTTACAATCAGCTG

CTGACCCAGACCCAGATTGATCTGTATAACCAACTGCTGGGTGGTATTAGCCGTGAAGCAGGCACCGAAAAA

ATCAAAGGTCTGAATGAAGTGCTGAATCTGGCCATTCAGAAAAATGATGAAACCGCACATATTATTGCAAGCC

TGCCGCATCGTTTTATTCCGCTGTTCAAACAAATTCTGAGCGATCGTAATACCCTGAGCTTTATTCTGGAAGAA

TTCAAATCCGATGAAGAGGTGATTCAGAGCTTTTGCAAATACAAAACGCTGCTGCGCAATGAAATGTTCTGG

AAACTGCCGAAGCACTGTTTAACGAACTGAATAGCATTGATCTGACCCACATCTTTATCAGCCACAAAAAACT

GGAAACCATTTCAAGCGCACTGTGTGATCATTGGGATACCCTGCGTAATGCCCTGTATGAACGTCGTATTAGC

GAACTGACCGGTAAAATTACCAAAAGCGCGAAAGAAAAAGTTCAGCGCAGTCTGAAACATGAGGATATTAAT

CTGCAAGAGATTATTAGCGCAGCCGGTAAAGAACTGTCAGAAGCATTTAAACAGAAAACCAGCGAAATTCTG

TCACATGCACATGCAGCACTGGATCAGCCGCTGCCGACCACCCTGAAAAAACAAGAAGAAAAAGAAATCCTG

AAAAGCCAGCTGGATAGCCTGCTGGGTCTGTATCATCTGCTGGACTGGTTTGCAGTTGATGAAAGCAATGAA

GTTGATCCGGAATTTAGCGCACGTCTGACCGGCATTAAACTGGAAATGGAACCGAGCCTGAGCTTTTATAACA

AAGCCCGTAATTATGCCACCAAAAAACCGTATAGCGTCGAAAAATTCAAACTGAACTTTCAGATGCCGACCCT

GGCAAGCGGTTGGGATGTTAATAAAGAAAAAAACAACGGTGCCATCCTGTTCGTGAAAAATGGCCTGTATTA

TCTGGGTATTATGCCGAAACAGAAAGGTCGTTATAAAGCGCTGAGCTTTGAACCGACGGAAAAAACCAGTGA

AGGTTTTGATAAAATGTACTACGACTATTTTCCGGATGCAGCCAAAATGATTCCGAAATGTAGCACCCAGCTG

AAAGCAGTTACCGCACATTTTCAGACCCATACCACCCCGATTCTGCTGAGCAATAACTTTATTGAACCGCTGGA

AATCACCAAAGAGATCTACGATCTGAATAACCCGGAAAAAGAGCCGAAAAAATTCCAGACCGCATATGCAAA

AAAAACCGGTGATCAGAAAGGTTATCGTGAAGCGCTGTGTAAATGGATTGATTTCACCCGTGATTTTCTGAGC

AAATACACCAAAACCACCAGTATCGATCTGAGCAGCCTGCGTCCGAGCAGCCAGTATAAAGATCTGGGCGAA

TATTATGCAGAACTGAATCCGCTGCTGTATCATATTAGCTTTCAGCGTATTGCCGAGAAAGAAATCATGGACG

CAGTTGAAACCGGTAAACTGTACCTGTTCCAGATCTACAATAAAGATTTTGCCAAAGGCCATCATGGCAAACC

GAATCTGCATACCCTGTATTGGACCGGTCTGTTTAGCCCTGAAAATCTGGCAAAAACCTCGATTAAACTGAAT

GGTCAGGCGAACTGTTTTATCGTCCGAAAAGCCGTATGAAACGTATGGCACATCGTCTGGGTGAAAAAATG

CTGAACAAAAAACTGAAAGACCAGAAAACCCCGATCCCGGATACACTGTATCAAGAACTGTATGATTATGTGA

ACCATCGTCTGAGCCATGATCTGAGTGATGAAGCACGTGCCCTGCTGCCGAATGTTATTACCAAAGAAGTTAG

CCACGAGATCATTAAAGATCGTCGTTTTACCAGCGACAAATTCTTTTTCATGTGCCGATTACCCTGAATTATCA

GGCAGCAAATAGCCCGAGCAAATTTAACCAGCGTGTTAATGCATATCTGAAAGAACATCCAGAAACGCCGATT

ATTGGTATTGATCGTGGTGAACGTAACCTGATTTATATCACCGTTATTGATAGCACCGGCAAAATCCTGGAAC

AGCGTAGCCTGAATACCATTCAGCAGTTTGATTACCAGAAAAAACTGGATAATCGCGAGAAGAACGTGTTG

CAGCACGTCAGGCATGGTCAGTTGTTGGTACAATTAAAGACCTGAAACAGGGTTATCTGAGCCAGGTTATTCA

TGAAATTGTGGATCTGATGATTCACTATCAGGCCGTTGTTGTGCTGGAAAACCTGAATTTTGGCTTTAAAAGC

AAACGTACCGGCATTGCAGAAAAAGCAGTTTATCAGCAGTTCGAGAAAATGCTGATTGACAAACTGAATTGC

CTGGTGCTGAAAGATTATCCGGCTGAAAAAGTTGGTGGTGTTCTGAATCCGTATCAGCTGACCGATCAGTTTA

CCAGCTTTGCAAAAATGGGCACCCAGAGCGGATTTCTGTTTTATGTTCCGGCACCGTATACGAGCAAATTGA

TCCGCTGACCGGTTTTGTTGATCCGTTTGTTTGGAAAACCATCAAAACCATGAAAGCCGCAAACATTTTCTGG

AAGGTTTCGATTTTCTGCATTACGACGTTAAAACGGGTGATTTCATCCTGCACTTTAAAATGAATCGCAATCTG

AGTTTTCAGCGTGGCCTGCCTGGTTTTATGCCTGCATGGGATATTGTGTTTGAGAAAAACGAAACACAGTTCG

ATGCAAAAGGCACCCCGTTTATTGCAGGTAAACGTATTGTTCCGGTGATTGAAAATCATCGTTTCACCGGTCGT

TATCGCGATCTGTATCCGGCAAATGAACTGATCGCACTGCTGGAAGAGAAAGGTATTGTTTTTCGTGATGGCT
```

-continued

CAAACATTCTGCCGAAACTGCTGGAAAATGATGATAGCCATGCAATTGATACCATGGTTGCACTGATTCGTAG
CGTTCTGCAGATGCGTAATAGCAATGCAGCAACCGGTGAAGATTACATTAATAGTCCGGTTCGTGATCTGAAT
GGTGTTTGTTTTGATAGCCGTTTTCAGAATCCGGAATGGCCGATGGATGCAGATGCAAATGGTGCATATCATA
TTGCACTGAAAGGACAGCTGCTGCTGAACCACCTGAAAGAAAGCAAAGATCTGAAACTGCAAACGGCATTA
GCAATCAGGATTGGCTGGCATATATCCAAGAACTGCGTAACCCGAAAAAAAAACGCAAAGTGCTCGAGCACC
ACCACCACCACCACTGA

SEQ ID NO.: 8
ATGACCCAGTTTGAAGGTTTCACCAATCTGTATCAGGTTAGCAAAACCCTGCGTTTTGAACT
GATTCCGCAGGGTAAAACCCTGAAACATATTCAAGAACAGGGCTTCATCGAAGAGGATAAAGCACGTAACGA
TCACTACAAAGAACTGAAACCGATTATCGACCGCATCTATAAAACCTATGCAGATCAGTGTCTGCAGCTGGTT
CAGCTGGATTGGGAAAATCTGAGCGCAGCAATTGATAGTTATCGCAAAGAAAAAACCGAAGAAACCCGTAAT
GCACTGATTGAAGAACAGGCAACCTATCGTAATGCCATCCATGATTATTTCATTGGTCGTACCGATAATCTGAC
CGATGCAATTAACAAACGTCACGCCGAAATCTATAAAGGCCTGTTTAAAGCCGAACTGTTTAATGGCAAAGTT
CTGAAACAGCTGGGCACCGTTACCACCACCGAACATGAAAATGCACTGCTGCGTAGCTTTGATAAATTCACCA
CCTATTTCAGCGGCTTTTATGAGAATCGCAAAAACGTGTTTAGCGCAGAAGATATTAGCACCGCAATTCCGCA
TCGTATTGTGCAGGATAATTTCCCGAAATTCAAAGAGAACTGCCACATTTTTACCCGTCTGATTACCGCAGTTC
CGAGCCTGCGTGAACATTTTGAAAACGTTAAAAAAGCCATCGGCATCTTTGTTAGCACCAGCATTGAAGAAGT
TTTTAGCTTCCCGTTTTACAATCAGCTGCTGACCCAGACCCAGATTGATCTGTATAACCAACTGCTGGGTGGTA
TTAGCCGTGAAGCAGGCACCGAAAAAATCAAAGGTCTGAATGAAGTGCTGAATCTGGCCATTCAGAAAATG
ATGAAACCGCACATATTATTGCAAGCCTGCCGCATCGTTTTATTCCGCTGTTCAAACAAATTCTGAGCGATCGT
AATACCCTGAGCTTTATTCTGGAAGAATTCAAATCCGATGAAGAGGTGATTCAGAGCTTTTGCAAATACAAAA
CGCTGCTGCGCAATGAAAATGTTCTGGAAACTGCCGAAGCACTGTTTAACGAACTGAATAGCATTGATCTGAC
CCACATCTTTATCAGCCACAAAAAACTGGAAACCATTTCAAGCGCACTGTGTGATCATTGGGATACCCTGCGTA
ATGCCCTGTATGAACGTCGTATTAGCGAACTGACCGGTAAAATTACCAAAAGCGCGAAAGAAAAAGTTCAGC
GCAGTCTGAAACATGAGGATATTAATCTGCAAGAGATTATTAGCGCAGCCGGTAAAGAACTGTCAGAAGCAT
TTAAACAGAAAACCAGCGAAATTCTGTCACATGCACATGCAGCACTGGATCAGCCGCTGCCGACCACCCTGAA
AAAACAAGAAGAAAAGAAATCCTGAAAAGCCAGCTGGATAGCCTGCTGGGTCTGTATCATCTGCTGGACTG
GTTTGCAGTTGATGAAAGCAATGAAGTTGATCCGGAATTTAGCGCACGTCTGACCGGCATTAAACTGGAAAT
GGAACCGAGCCTGAGCTTTTATAACAAAGCCCGTAATTATGCCACCAAAAAACCGTATAGCGTCGAAAAATTC
AAACTGAACTTTCAGATGCCGACCCTGGCAAGCGGTTGGGATGTTAATAAAGAAAAAAACAACGGTGCCATC
CTGTTCGTGAAAAATGGCCTGTATTATCTGGGTATTATGCCGAAACAGAAAGGTCGTTATAAAGCGCTGAGCT
TTGAACCGACGGAAAAAACCAGTGAAGGTTTTGATAAAATGTACTACGACTATTTTCCGGATGCAGCCAAAAT
GATTCCGAAATGTAGCACCCAGCTGAAAGCAGTTACCGCACATTTTCAGACCCATACCACCCCGATTCTGCTGA
GCAATAACTTTATTGAACCGCTGGAAATCACCAAAGAGATCTACGATCTGAATAACCCGGAAAAAGAGCCGA
AAAAATTCCAGACCGCATATGCAAAAAAACCGGTGATCAGAAAGGTTATCGTGAAGCGCTGTGTAAATGGA
TTGATTTCACCCGTGATTTTCTGAGCAAATACACCAAAACCACCAGTATCGATCTGAGCAGCCTGCGTCCGAGC
AGCCAGTATAAAGATCTGGGCGAATATTATGCAGAACTGAATCCGCTGCTGTATCATATTAGCTTTCAGCGTA
TTGCCGAGAAAGAAATCATGGACGCAGTTGAAACCGGTAAACTGTACCTGTTCCAGATCTACAATAAAGATTT
TGCCAAAGGCCATCATGGCAAACCGAATCTGCATACCCTGTATTGGACCGGTCTGTTTAGCCCTGAAAATCTG
GCAAAAACCTCGATTAAACTGAATGGTCAGGCGGAACTGTTTTATCGTCCGAAAAGCCGTATGAAACGTATG
GCACATCGTCTGGGTGAAAAAATGCTGAACAAAAAACTGAAAGACCAGAAAACCCCGATCCCGGATACACTG

-continued

```
TATCAAGAACTGTATGATTATGTGAACCATCGTCTGAGCCATGATCTGAGTGATGAAGCACGTGCCCTGCTGC

CGAATGTTATTACCAAAGAAGTTAGCCACGAGATCATTAAAGATCGTCGTTTTACCAGCGACAAATTCTTTTTT

CATGTGCCGATTACCCTGAATTATCAGGCAGCAAATAGCCCGAGCAAATTTAACCAGCGTGTTAATGCATATC

TGAAAGAACATCCAGAAACGCCGATTATTGGTATTGATCGTGGTGAACGTAACCTGATTTATATCACCGTTATT

GATAGCACCGGCAAAATCCTGGAACAGCGTAGCCTGAATACCATTCAGCAGTTTGATTACCAGAAAAAACTG

GATAATCGCGAGAAGAACGTGTTGCAGCACGTCAGGCATGGTCAGTTGTTGGTACAATTAAAGACCTGAAA

CAGGGTTATCTGAGCCAGGTTATTCATGAAATTGTGGATCTGATGATTCACTATCAGGCCGTTGTTGTGCTGG

AAAACCTGAATTTTGGCTTTAAAAGCAAACGTACCGGCATTGCAGAAAAAGCAGTTTATCAGCAGTTCGAGAA

AATGCTGATTGACAAACTGAATTGCCTGGTGCTGAAAGATTATCCGGCTGAAAAAGTTGGTGGTGTTCTGAAT

CCGTATCAGCTGACCGATCAGTTTACCAGCTTTGCAAAAATGGGCACCCAGAGCGGATTTCTGTTTTATGTTCC

GGCACCGTATACGAGCAAAATTGATCCGCTGACCGGTTTTGTTGATCCGTTTGTTTGGAAAACCATCAAAAAC

CATGAAAGCCGCAAACATTTTCTGGAAGGTTTCGATTTTCTGCATTACGACGTTAAAACGGGTGATTTCATCCT

GCACTTTAAAATGAATCGCAATCTGAGTTTTCAGCGTGGCCTGCCTGGTTTTATGCCTGCATGGGATATTGTGT

TTGAGAAAAACGAAACACAGTTCGATGCAAAAGGCACCCCGTTTATTGCAGGTAAACGTATTGTTCCGGTGAT

TGAAAATCATCGTTTCACCGGTCGTTATCGCGATCTGTATCCGGCAAATGAACTGATCGCACTGCTGGAAGAG

AAAGGTATTGTTTTTCGTGATGGCTCAAACATTCTGCCGAAACTGCTGGAAAATGATGATAGCCATGCAATTG

ATACCATGGTTGCACTGATTCGTAGCGTTCTGCAGATGCGTAATAGCAATGCAGCAACCGGTGAAGATTACAT

TAATAGTCCGGTTCGTGATCTGAATGGTGTTTGTTTTGATAGCCGTTTTCAGAATCCGGAATGGCCGATGGAT

GCAGATGCAAATGGTGCATATCATATTGCACTGAAAGGACAGCTGCTGCTGAACCACCTGAAAGAAAGCAAA

GATCTGAAACTGCAAAACGGCATTAGCAATCAGGATTGGCTGGCATATATCCAAGAACTGCGTAACCCGAAA

AAAAAACGCAAAGTGCTCGAGCACCACCACCACCACCACTGA
```

SEQ ID NO.: 9

```
ATGGGCAGCAGCCATCATCATCATCATCACAGCAGCGGCCTGGTGCCGCGCGGCAGCCATA

TGGCTAGCATGACTGGTGGACAGCAAATGGGTCGGGATCCAACCCAGTTTGAAGGTTTCACCAATCTGTATCA

GGTTAGCAAAACCCTGCGTTTTGAACTGATTCCGCAGGGTAAAACCCTGAAACATATTCAAGAACAGGGCTTC

ATCGAAGAGGATAAAGCACGTAACGATCACTACAAAGAACTGAAACCGATTATCGACCGCATCTATAAAACCT

ATGCAGATCAGTGTCTGCAGCTGGTTCAGCTGGATTGGGAAAATCTGAGCGCAGCAATTGATAGTTATCGCA

AAGAAAAAACCGAAGAAACCCGTAATGCACTGATTGAAGAACAGGCAACCTATCGTAATGCCATCCATGATT

ATTTCATTGGTCGTACCGATAATCTGACCGATGCAATTAACAAACGTCACGCCGAAATCTATAAAGGCCTGTTT

AAAGCCGAACTGTTTAATGGCAAAGTTCTGAAACAGCTGGGCACCGTTACCACCACCGAACATGAAAATGCAC

TGCTGCGTAGCTTTGATAAATTCACCACCTATTTCAGCGGCTTTTATGAGAATCGCAAAAACGTGTTTAGCGCA

GAAGATATTAGCACCGCAATTCCGCATCGTATTGTGCAGGATAATTTCCCGAAATTCAAAGAGAACTGCCACA

TTTTTACCCGTCTGATTACCGCAGTTCCGAGCCTGCGTGAACATTTTGAAACGTTAAAAAAGCCATCGGCATC

TTTGTTAGCACCAGCATTGAAGAAGTTTTTAGCTTCCCGTTTTACAATCAGCTGCTGACCCAGACCCAGATTGA

TCTGTATAACCAACTGCTGGGTGGTATTAGCCGTGAAGCAGGCACCGAAAAAATCAAAGGTCTGAATGAAGT

GCTGAATCTGGCCATTCAGAAAAATGATGAAACCGCACATATTATTGCAAGCCTGCCGCATCGTTTTATTCCGC

TGTTCAAACAAATTCTGAGCGATCGTAATACCCTGAGCTTTATTCTGGAAGAATTCAAATCCGATGAAGAGGT

GATTCAGAGCTTTTGCAAATACAAAACGCTGCTGCGCAATGAAAATGTTCTGGAAACTGCCGAAGCACTGTTT

AACGAACTGAATAGCATTGATCTGACCCACATCTTTATCAGCCACAAAAAACTGGAAACCATTTCAAGCGCACT

GTGTGATCATTGGGATACCCTGCGTAATGCCCTGTATGAACGTCGTATTAGCGAACTGACCGGTAAAATTACC

AAAAGCGCGAAAGAAAAGTTCAGCGCAGTCTGAAACATGAGGATATTAATCTGCAAGAGATTATTAGCGCA
```

-continued

```
GCCGGTAAAGAACTGTCAGAAGCATTTAAACAGAAAACCAGCGAAATTCTGTCACATGCACATGCAGCACTG
GATCAGCCGCTGCCGACCACCCTGAAAAAACAAGAAGAAAAAGAAATCCTGAAAAGCCAGCTGGATAGCCTG
CTGGGTCTGTATCATCTGCTGGACTGGTTTGCAGTTGATGAAAGCAATGAAGTTGATCCGGAATTTAGCGCAC
GTCTGACCGGCATTAAACTGGAAATGGAACCGAGCCTGAGCTTTTATAACAAAGCCCGTAATTATGCCACCAA
AAAACCGTATAGCGTCGAAAAATTCAAACTGAACTTTCAGATGCCGACCCTGGCAAGCGGTTGGGATGTTAAT
AAAGAAAAAACAACGGTGCCATCCTGTTCGTGAAAAATGGCCTGTATTATCTGGGTATTATGCCGAAACAGA
AAGGTCGTTATAAAGCGCTGAGCTTTGAACCGACGGAAAAAACCAGTGAAGGTTTTGATAAAATGTACTACG
ACTATTTTCCGGATGCAGCCAAAATGATTCCGAAATGTAGCACCCAGCTGAAAGCAGTTACCGCACATTTTCA
GACCCATACCACCCCGATTCTGCTGAGCAATAACTTTATTGAACCGCTGGAAATCACCAAAGAGATCTACGAT
CTGAATAACCCGGAAAAAGAGCCGAAAAAATTCCAGACCGCATATGCAAAAAAAACCGGTGATCAGAAAGGT
TATCGTGAAGCGCTGTGTAAATGGATTGATTTCACCCGTGATTTTCTGAGCAAATACACCAAAACCACCAGTAT
CGATCTGAGCAGCCTGCGTCCGAGCAGCCAGTATAAAGATCTGGGCAATATTATGCAGAACTGAATCCGCT
GCTGTATCATATTAGCTTTCAGCGTATTGCCGAGAAAGAAATCATGGACGCAGTTGAAACCGGTAAACTGTAC
CTGTTCCAGATCTACAATAAAGATTTTGCCAAAGGCCATCATGGCAAACCGAATCTGCATACCCTGTATTGGAC
CGGTCTGTTTAGCCCTGAAAATCTGGCAAAAACCTCGATTAAACTGAATGGTCAGGCGGAACTGTTTTATCGT
CCGAAAAGCCGTATGAAACGTATGGCACATCGTCTGGGTGAAAAAATGCTGAACAAAAAACTGAAAGACCAG
AAAACCCCGATCCCGGATACACTGTATCAAGAACTGTATGATTATGTGAACCATCGTCTGAGCCATGATCTGA
GTGATGAAGCACGTGCCCTGCTGCCGAATGTTATTACCAAAGAAGTTAGCCACGAGATCATTAAAGATCGTCG
TTTTACCAGCGACAAATTCTTTTTTCATGTGCCGATTACCCTGAATTATCAGGCAGCAAATAGCCCGAGCAAAT
TTAACCAGCGTGTTAATGCATATCTGAAAGAACATCCAGAAACGCCGATTATTGGTATTGATCGTGGTGAACG
TAACCTGATTTATATCACCGTTATTGATAGCACCGGCAAAATCCTGGAACAGCGTAGCCTGAATACCATTCAGC
AGTTTGATTACCAGAAAAAACTGGATAATCGCGAGAAAGAACGTGTTGCAGCACGTCAGGCATGGTCAGTTG
TTGGTACAATTAAAGACCTGAAACAGGGTTATCTGAGCCAGGTTATTCATGAAATTGTGGATCTGATGATTCA
CTATCAGGCCGTTGTTGTGCTGGAAAACCTGAATTTTGGCTTTAAAAGCAAACGTACCGGCATTGCAGAAAAA
GCAGTTTATCAGCAGTTCGAGAAAATGCTGATTGACAAACTGAATTGCCTGGTGCTGAAAGATTATCCGGCTG
AAAAAGTTGGTGGTGTTCTGAATCCGTATCAGCTGACCGATCAGTTTACCAGCTTTGCAAAAATGGGCACCCA
GAGCGGATTTCTGTTTTATGTTCCGGCACCGTATACGAGCAAAATTGATCCGCTGACCGGTTTTGTTGATCCGT
TTGTTTGGAAAACCATCAAAAACCATGAAAGCCGCAAACATTTTCTGGAAGGTTTCGATTTTCTGCATTACGAC
GTTAAAACGGGTGATTTCATCCTGCACTTTAAAATGAATCGCAATCTGAGTTTTCAGCGTGGCCTGCCTGGTTT
TATGCCTGCATGGGATATTGTGTTTGAGAAAAACGAAACACAGTTCGATGCAAAAGGCACCCCGTTTATTGCA
GGTAAACGTATTGTTCCGGTGATTGAAAATCATCGTTTCACCGGTCGTTATCGCGATCTGTATCCGGCAAATG
AACTGATCGCACTGCTGGAAGAGAAAGGTATTGTTTTTCGTGATGGCTCAAACATTCTGCCGAAACTGCTGGA
AAATGATGATAGCCATGCAATTGATACCATGGTTGCACTGATTCGTAGCGTTCTGCAGATGCGTAATAGCAAT
GCAGCAACCGGTGAAGATTACATTAATAGTCCGGTTCGTGATCTGAATGGTGTTTGTTTTGATAGCCGTTTTCA
GAATCCGGAATGGCCGATGGATGCAGATGCAAATGGTGCATATCATATTGCACTGAAGGACAGCTGCTGCT
GAACCACCTGAAAGAAAGCAAAGATCTGAAACTGCAAAACGGCATTAGCAATCAGGATTGGCTGGCATATAT
CCAAGAACTGCGTAACGGTCGTAGCAGTGATGATGAAGCAACCGCAGATAGCCAGCATGCAGCACCGCCTAA
AAAGAAACGTAAAGTTGGTGGTAGCGGTGGTTCAGGTGGTAGTGGCGGTAGTGGTGGCTCAGGGGGTTCTG
GTGGCTCTGGTGGTAGCCCTCGAGCACCACCACCACCACCACTGA
```

SEQ ID NO.: 10

```
ATGACCCAGTTTGAAGGTTTCACCAATCTGTATCAGGTTAGCAAAACCCTGCGTTTTGAACT
GATTCCGCAGGGTAAAACCCTGAAACATATTCAAGAACAGGGCTTCATCGAAGAGGATAAAGCACGTAACGA
TCACTACAAAGAACTGAAACCGATTATCGACCGCATCTATAAAACCTATGCAGATCAGTGTCTGCAGCTGGTT
CAGCTGGATTGGGAAAATCTGAGCGCAGCAATTGATAGTTATCGCAAAGAAAAAACCGAAGAAACCCGTAAT
GCACTGATTGAAGAACAGGCAACCTATCGTAATGCCATCCATGATTATTTCATTGGTCGTACCGATAATCTGAC
CGATGCAATTAACAAACGTCACGCCGAAATCTATAAAGGCCTGTTTAAAGCCGAACTGTTTAATGGCAAAGTT
CTGAAACAGCTGGGCACCGTTACCACCACCGAACATGAAAATGCACTGCTGCGTAGCTTTGATAAATTCACCA
CCTATTTCAGCGGCTTTTATGAGAATCGCAAAAACGTGTTTAGCGCAGAAGATATTAGCACCGCAATTCCGCA
TCGTATTGTGCAGGATAATTTCCCGAAATTCAAAGAGAACTGCCACATTTTTACCCGTCTGATTACCGCAGTTC
CGAGCCTGCGTGAACATTTTGAAAACGTTAAAAAAGCCATCGGCATCTTTGTTAGCACCAGCATTGAAGAAGT
TTTTAGCTTCCCGTTTTACAATCAGCTGCTGACCCAGACCCAGATTGATCTGTATAACCAACTGCTGGGTGGTA
TTAGCCGTGAAGCAGGCACCGAAAAAATCAAAGGTCTGAATGAAGTGCTGAATCTGGCCATTCAGAAAAATG
ATGAAACCGCACATATTATTGCAAGCCTGCCGCATCGTTTTATTCCGCTGTTCAAACAAATTCTGAGCGATCGT
AATACCCTGAGCTTTATTCTGGAAGAATTCAAATCCGATGAAGAGGTGATTCAGAGCTTTTGCAAATACAAA
CGCTGCTGCGCAATGAAAATGTTCTGGAAACTGCCGAAGCACTGTTTAACGAACTGAATAGCATTGATCTGAC
CCACATCTTTATCAGCCACAAAAAACTGGAAACCATTTCAAGCGCACTGTGTGATCATTGGGATACCCTGCGTA
ATGCCCTGTATGAACGTCGTATTAGCGAACTGACCGGTAAAATTACCAAAAGCGCGAAAGAAAAAGTTCAGC
GCAGTCTGAAACATGAGGATATTAATCTGCAAGAGATTATTAGCGCAGCCGGTAAAGAACTGTCAGAAGCAT
TTAAACAGAAAACCAGCGAAATTCTGTCACATGCACATGCAGCACTGGATCAGCCGCTGCCGACCACCCTGAA
AAAACAAGAAGAAAAAGAAATCCTGAAAAGCCAGCTGGATAGCCTGCTGGGTCTGTATCATCTGCTGGACTG
GTTTGCAGTTGATGAAAGCAATGAAGTTGATCCGGAATTTAGCGCACGTCTGACCGGCATTAAACTGGAAAT
GGAACCGAGCCTGAGCTTTTATAACAAAGCCCGTAATTATGCCACCAAAAAACCGTATAGCGTCGAAAAATTC
AAACTGAACTTTCAGATGCCGACCCTGGCAAGCGGTTGGGATGTTAATAAAGAAAAAAACAACGGTGCCATC
CTGTTCGTGAAAAATGGCCTGTATTATCTGGGTATTATGCCGAAACAGAAAGGTCGTTATAAAGCGCTGAGCT
TTGAACCGACGGAAAAAACCAGTGAAGGTTTTGATAAAATGTACTACGACTATTTTCCGGATGCAGCCAAAAT
GATTCCGAAATGTAGCACCCAGCTGAAAGCAGTTACCGCACATTTTCAGACCCATACCACCCCGATTCTGCTGA
GCAATAACTTTATTGAACCGCTGGAAATCACCAAAGAGATCTACGATCTGAATAACCCGGAAAAAGAGCCGA
AAAAATTCCAGACCGCATATGCAAAAAAAACCGGTGATCAGAAAGGTTATCGTGAAGCGCTGTGTAAATGGA
TTGATTTCACCCGTGATTTTCTGAGCAAATACACCAAAACCACCAGTATCGATCTGAGCAGCCTGCGTCCGAGC
AGCCAGTATAAAGATCTGGGCGAATATTATGCAGAACTGAATCCGCTGCTGTATCATATTAGCTTTCAGCGTA
TTGCCGAGAAAGAAATCATGGACGCAGTTGAAACCGGTAAACTGTACCTGTTCCAGATCTACAATAAAGATTT
TGCCAAAGGCCATCATGGCAAACCGAATCTGCATACCCTGTATTGGACCGGTCTGTTTAGCCCTGAAAATCTG
GCAAAAACCTCGATTAAACTGAATGGTCAGGCGGAACTGTTTTATCGTCCGAAAAGCCGTATGAAACGTATG
GCACATCGTCTGGGTGAAAAAATGCTGAACAAAAACTGAAAGACCAGAAAACCCCGATCCCGGATACACTG
TATCAAGAACTGTATGATTATGTGAACCATCGTCTGAGCCATGATCTGAGTGATGAAGCACGTGCCCTGCTGC
CGAATGTTATTACCAAAGAAGTTAGCCACGAGATCATTAAAGATCGTCGTTTTACCAGCGACAAATTCTTTTTT
CATGTGCCGATTACCCTGAATTATCAGGCAGCAAATAGCCCGAGCAAATTTAACCAGCGTGTTAATGCATATC
TGAAAGAACATCCAGAAACGCCGATTATTGGTATTGATCGTGGTGAACGTAACCTGATTTATATCACCGTTATT
GATAGCACCGGCAAAATCCTGGAACAGCGTAGCCTGAATACCATTCAGCAGTTTGATTACCAGAAAAACTG
GATAATCGCGAGAAAGAACGTGTTGCAGCACGTCAGGCATGGTCAGTTGTTGGTACAATTAAAGACCTGAAA
```

CAGGGTTATCTGAGCCAGGTTATTCATGAAATTGTGGATCTGATGATTCACTATCAGGCCGTTGTTGTGCTGG

AAAACCTGAATTTTGGCTTTAAAAGCAAACGTACCGGCATTGCAGAAAAAGCAGTTTATCAGCAGTTCGAGAA

AATGCTGATTGACAAACTGAATTGCCTGGTGCTGAAAGATTATCCGGCTGAAAAAGTTGGTGGTGTTCTGAAT

CCGTATCAGCTGACCGATCAGTTTACCAGCTTTGCAAAAATGGGCACCCAGAGCGGATTTCTGTTTTATGTTCC

GGCACCGTATACGAGCAAAATTGATCCGCTGACCGGTTTTGTTGATCCGTTTGTTTGGAAAACCATCAAAAAC

CATGAAAGCCGCAAACATTTTCTGGAAGGTTTCGATTTTCTGCATTACGACGTTAAAACGGGTGATTTCATCCT

GCACTTTAAAATGAATCGCAATCTGAGTTTTCAGCGTGGCCTGCCTGGTTTTATGCCTGCATGGGATATTGTGT

TTGAGAAAAACGAAACACAGTTCGATGCAAAAGGCACCCCGTTTATTGCAGGTAAACGTATTGTTCCGGTGAT

TGAAAATCATCGTTTCACCGGTCGTTATCGCGATCTGTATCCGGCAAATGAACTGATCGCACTGCTGGAAGAG

AAAGGTATTGTTTTTCGTGATGGCTCAAACATTCTGCCGAAACTGCTGGAAAATGATGATAGCCATGCAATTG

ATACCATGGTTGCACTGATTCGTAGCGTTCTGCAGATGCGTAATAGCAATGCAGCAACCGGTGAAGATTACAT

TAATAGTCCGGTTCGTGATCTGAATGGTGTTTGTTTTGATAGCCGTTTTCAGAATCCGGAATGGCCGATGGAT

GCAGATGCAAATGGTGCATATCATATTGCACTGAAAGGACAGCTGCTGCTGAACCACCTGAAAGAAAGCAAA

GATCTGAAACTGCAAAACGGCATTAGCAATCAGGATTGGCTGGCATATATCCAAGAACTGCGTAACGGTCGT

AGCAGTGATGATGAAGCAACCGCAGATAGCCAGCATGCAGCACCGCCTAAAAAGAAACGTAAAGTTGGTGG

TAGCGGTGGTTCAGGTGGTAGTGGCGGTAGTGGTGGCTCAGGGGGTTCTGGTGGCTCTGGTGGTAGCCTCG

AGCACCACCACCACCACCACTGA

SEQ ID NO.: 11

ATGGGCAGCAGCAGCAGCGGCCTGGTGCCGCGCGGCAGCCATATGGCTAGCATGACTGGT

GGACAGCAAATGGGTCGGGATCCAACCCAGTTTGAAGGTTTCACCAATCTGTATCAGGTTAGCAAAACCCTGC

GTTTTGAACTGATTCCGCAGGGTAAAACCCTGAAACATATTCAAGAACAGGGCTTCATCGAAGAGGATAAAG

CACGTAACGATCACTACAAAGAACTGAAACCGATTATCGACCGCATCTATAAAACCTATGCAGATCAGTGTCT

GCAGCTGGTTCAGCTGGATTGGGAAAATCTGAGCGCAGCAATTGATAGTTATCGCAAAGAAAAAACCGAAGA

AACCCGTAATGCACTGATTGAAGAACAGGCAACCTATCGTAATGCCATCCATGATTATTTCATTGGTCGTACCG

ATAATCTGACCGATGCAATTAACAAACGTCACGCCGAAATCTATAAAGGCCTGTTTAAAGCCGAACTGTTTAA

TGGCAAAGTTCTGAAACAGCTGGGCACCGTTACCACCACCGAACATGAAAATGCACTGCTGCGTAGCTTTGAT

AAATTCACCACCTATTTCAGCGGCTTTTATGAGAATCGCAAAAACGTGTTTAGCGCAGAAGATATTAGCACCG

CAATTCCGCATCGTATTGTGCAGGATAATTTCCCGAAATTCAAAGAGAACTGCCACATTTTTACCCGTCTGATT

ACCGCAGTTCCGAGCCTGCGTGAACATTTTGAAAACGTTAAAAAAGCCATCGGCATCTTTGTTAGCACCAGCA

TTGAAGAAGTTTTTAGCTTCCCGTTTTACAATCAGCTGCTGACCCAGACCCAGATTGATCTGTATAACCAACTG

CTGGGTGGTATTAGCCGTGAAGCAGGCACCGAAAAAATCAAAGGTCTGAATGAAGTGCTGAATCTGGCCATT

CAGAAAAATGATGAAACCGCACATATTATTGCAAGCCTGCCGCATCGTTTTATTCCGCTGTTCAAACAAATTCT

GAGCGATCGTAATACCCTGAGCTTTATTCTGGAAGAATTCAAATCCGATGAAGAGGTGATTCAGAGCTTTTGC

AAATACAAAACGCTGCTGCGCAATGAAAATGTTCTGGAAACTGCCGAAGCACTGTTTAACGAACTGAATAGCA

TTGATCTGACCCACATCTTTATCAGCCACAAAAAACTGGAAACCATTTCAAGCGCACTGTGTGATCATTGGGAT

ACCCTGCGTAATGCCCTGTATGAACGTCGTATTAGCGAACTGACCGGTAAAATTACCAAAAGCGCGAAAGAA

AAAGTTCAGCGCAGTCTGAAACATGAGGATATTAATCTGCAAGAGATTATTAGCGCAGCCGGTAAAGAACTG

TCAGAAGCATTTAAACAGAAAACCAGCGAAATTCTGTCACATGCACATGCAGCACTGGATCAGCCGCTGCCGA

CCACCCTGAAAAAACAAGAAGAAAAGAAATCCTGAAAAGCCAGCTGGATAGCCTGCTGGGTCTGTATCATC

TGCTGGACTGGTTTGCAGTTGATGAAAGCAATGAAGTTGATCCGGAATTTAGCGCACGTCTGACCGGCATTAA

ACTGGAAATGGAACCGAGCCTGAGCTTTTATAACAAAGCCCGTAATTATGCCACCAAAAAACCGTATAGCGTC

-continued

```
GAAAAATTCAAACTGAACTTTCAGATGCCGACCCTGGCAAGCGGTTGGGATGTTAATAAAGAAAAAAACAAC
GGTGCCATCCTGTTCGTGAAAAATGGCCTGTATTATCTGGGTATTATGCCGAAACAGAAAGGTCGTTATAAAG
CGCTGAGCTTTGAACCGACGGAAAAAACCAGTGAAGGTTTTGATAAAATGTACTACGACTATTTTCCGGATGC
AGCCAAAATGATTCCGAAATGTAGCACCCAGCTGAAAGCAGTTACCGCACATTTTCAGACCCATACCACCCCG
ATTCTGCTGAGCAATAACTTTATTGAACCGCTGGAAATCACCAAAGAGATCTACGATCTGAATAACCCGGAAA
AAGAGCCGAAAAAATTCCAGACCGCATATGCAAAAAAACCGGTGATCAGAAAGGTTATCGTGAAGCGCTGT
GTAAATGGATTGATTTCACCCGTGATTTTCTGAGCAAATACACCAAAACCACCAGTATCGATCTGAGCAGCCT
GCGTCCGAGCAGCCAGTATAAAGATCTGGGCGAATATTATGCAGAACTGAATCCGCTGCTGTATCATATTAGC
TTTCAGCGTATTGCCGAGAAAGAAATCATGGACGCAGTTGAAACCGGTAAACTGTACCTGTTCCAGATCTACA
ATAAAGATTTTGCCAAAGGCCATCATGGCAAACCGAATCTGCATACCCTGTATTGGACCGGTCTGTTTAGCCCT
GAAAATCTGGCAAAAACCTCGATTAAACTGAATGGTCAGGCGGAACTGTTTTATCGTCCGAAAAGCCGTATGA
AACGTATGGCACATCGTCTGGGTGAAAAAATGCTGAACAAAAAACTGAAAGACCAGAAAACCCCGATCCCGG
ATACACTGTATCAAGAACTGTATGATTATGTGAACCATCGTCTGAGCCATGATCTGAGTGATGAAGCACGTGC
CCTGCTGCCGAATGTTATTACCAAAGAAGTTAGCCACGAGATCATTAAAGATCGTCGTTTTACCAGCGACAAA
TTCTTTTTTCATGTGCCGATTACCCTGAATTATCAGGCAGCAAATAGCCCGAGCAAATTTAACCAGCGTGTTAA
TGCATATCTGAAAGAACATCCAGAAACGCCGATTATTGGTATTGATCGTGGTGAACGTAACCTGATTTATATC
ACCGTTATTGATAGCACCGGCAAAATCCTGGAACAGCGTAGCCTGAATACCATTCAGCAGTTTGATTACCAGA
AAAAACTGGATAATCGCGAGAAAGAACGTGTTGCAGCACGTCAGGCATGGTCAGTTGTTGGTACAATTAAAG
ACCTGAAACAGGGTTATCTGAGCCAGGTTATTCATGAAATTGTGGATCTGATGATTCACTATCAGGCCGTTGT
TGTGCTGGAAAACCTGAATTTTGGCTTTAAAAGCAAACGTACCGGCATTGCAGAAAAAGCAGTTTATCAGCAG
TTCGAGAAAATGCTGATTGACAAACTGAATTGCCTGGTGCTGAAAGATTATCCGGCTGAAAAAGTTGGTGGT
GTTCTGAATCCGTATCAGCTGACCGATCAGTTTACCAGCTTTGCAAAAATGGGCACCCAGAGCGGATTTCTGTT
TTATGTTCCGGCACCGTATACGAGCAAAATTGATCCGCTGACCGGTTTTGTTGATCCGTTTGTTTGGAAAACCA
TCAAAAACCATGAAAGCCGCAAACATTTTCTGGAAGGTTTCGATTTTCTGCATTACGACGTTAAAACGGGTGA
TTTCATCCTGCACTTTAAAATGAATCGCAATCTGAGTTTTCAGCGTGGCCTGCCTGGTTTTATGCCTGCATGGG
ATATTGTGTTTGAGAAAAACGAAACACAGTTCGATGCAAAAGGCACCCCGTTTATTGCAGGTAAACGTATTGT
TCCGGTGATTGAAAATCATCGTTTCACCGGTCGTTATCGCGATCTGTATCCGGCAAATGAACTGATCGCACTGC
TGGAAGAGAAAGGTATTGTTTTTCGTGATGGCTCAAACATTCTGCCGAAACTGCTGGAAAATGATGATAGCCA
TGCAATTGATACCATGGTTGCACTGATTCGTAGCGTTCTGCAGATGCGTAATAGCAATGCAGCAACCGGTGAA
GATTACATTAATAGTCCGGTTCGTGATCTGAATGGTGTTTGTTTTGATAGCCGTTTTCAGAATCCGGAATGGCC
GATGGATGCAGATGCAAATGGTGCATATCATATTGCACTGAAGGACAGCTGCTGCTGAACCACCTGAAAGA
AAGCAAAGATCTGAAACTGCAAAACGGCATTAGCAATCAGGATTGGCTGGCATATATCCAAGAACTGCGTAA
CGGTCGTAGCAGTGATGATGAAGCAACCGCAGATAGCCAGCATGCAGCACCGCCTAAAAAGAAACGTAAAGT
TGGTGGTAGCGGTGGTTCAGGTGGTAGTGGCGGTAGTGGTGGCTCAGGGGGTTCTGGTGGCTCTGGTGGTA
GCCTCGAGCACCACCACCACCACCACTGA
```

SEQ ID NO.: 12

```
ATGCCGCCTCCGAAACGTCCGCGTCTGGATGGTATCCACGGAGTCCCAGCAGCCACCCAGT
TTGAAGGTTTCACCAATCTGTATCAGGTTAGCAAAACCCTGCGTTTTGAACTGATTCCGCAGGGTAAAACCCTG
AAACATATTCAAGAACAGGGCTTCATCGAAGAGGATAAAGCACGTAACGATCACTACAAAGAACTGAAACCG
ATTATCGACCGCATCTATAAAACCTATGCAGATCAGTGTCTGCAGCTGGTTCAGCTGGATTGGGAAAATCTGA
GCGCAGCAATTGATAGTTATCGCAAAGAAAAAACCGAAGAAACCCGTAATGCACTGATTGAAGAACAGGCAA
```

-continued

```
CCTATCGTAATGCCATCCATGATTATTTCATTGGTCGTACCGATAATCTGACCGATGCAATTAACAAACGTCAC
GCCGAAATCTATAAAGGCCTGTTTAAAGCCGAACTGTTTAATGGCAAAGTTCTGAAACAGCTGGGCACCGTTA
CCACCACCGAACATGAAAATGCACTGCTGCGTAGCTTTGATAAATTCACCACCTATTTCAGCGGCTTTTATGAG
AATCGCAAAAACGTGTTTAGCGCAGAAGATATTAGCACCGCAATTCCGCATCGTATTGTGCAGGATAATTTCC
CGAAATTCAAAGAGAACTGCCACATTTTTACCCGTCTGATTACCGCAGTTCCGAGCCTGCGTGAACATTTTGAA
AACGTTAAAAAAGCCATCGGCATCTTTGTTAGCACCAGCATTGAAGAAGTTTTTAGCTTCCCGTTTTACAATCA
GCTGCTGACCCAGACCCAGATTGATCTGTATAACCAACTGCTGGGTGGTATTAGCCGTGAAGCAGGCACCGA
AAAAATCAAAGGTCTGAATGAAGTGCTGAATCTGGCCATTCAGAAAAATGATGAAACCGCACATATTATTGCA
AGCCTGCCGCATCGTTTTATTCCGCTGTTCAAACAAATTCTGAGCGATCGTAATACCCTGAGCTTTATTCTGGA
AGAATTCAAATCCGATGAAGAGGTGATTCAGAGCTTTTGCAAATACAAAACGCTGCTGCGCAATGAAATGTT
CTGGAAACTGCCGAAGCACTGTTTAACGAACTGAATAGCATTGATCTGACCCACATCTTTATCAGCCACAAAA
AACTGGAAACCATTTCAAGCGCACTGTGTGATCATTGGGATACCCTGCGTAATGCCCTGTATGAACGTCGTAT
TAGCGAACTGACCGGTAAAATTACCAAAAGCGCGAAAGAAAAAGTTCAGCGCAGTCTGAAACATGAGGATAT
TAATCTGCAAGAGATTATTAGCGCAGCCGGTAAAGAACTGTCAGAAGCATTTAAACAGAAAACCAGCGAAAT
TCTGTCACATGCACATGCAGCACTGGATCAGCCGCTGCCGACCACCCTGAAAAAACAAGAAGAAAAAGAAAT
CCTGAAAAGCCAGCTGGATAGCCTGCTGGGTCTGTATCATCTGCTGGACTGGTTTGCAGTTGATGAAAGCAAT
GAAGTTGATCCGGAATTTAGCGCACGTCTGACCGGCATTAAACTGGAAATGGAACCGAGCCTGAGCTTTTATA
ACAAAGCCCGTAATTATGCCACCAAAAAACCGTATAGCGTCGAAAAATTCAAACTGAACTTTCAGATGCCGAC
CCTGGCAAGCGGTTGGGATGTTAATAAAGAAAAAAACAACGGTGCCATCCTGTTCGTGAAAAATGGCCTGTA
TTATCTGGGTATTATGCCGAAACAGAAAGGTCGTTATAAAGCGCTGAGCTTTGAACCGACGGAAAAAACCAG
TGAAGGTTTTGATAAAATGTACTACGACTATTTTCCGGATGCAGCCAAAATGATTCCGAAATGTAGCACCCAG
CTGAAAGCAGTTACCGCACATTTTCAGACCCATACCACCCCGATTCTGCTGAGCAATAACTTTATTGAACCGCT
GGAAATCACCAAAGAGATCTACGATCTGAATAACCCGGAAAAAGAGCCGAAAAAATTCCAGACCGCATATGC
AAAAAAAACCGGTGATCAGAAAGGTTATCGTGAAGCGCTGTGTAAATGGATTGATTTCACCCGTGATTTTCTG
AGCAAATACACCAAAACCACCAGTATCGATCTGAGCAGCCTGCGTCCGAGCAGCCAGTATAAAGATCTGGGC
GAATATTATGCAGAACTGAATCCGCTGCTGTATCATATTAGCTTTCAGCGTATTGCCGAGAAAGAAATCATGG
ACGCAGTTGAAACCGGTAAACTGTACCTGTTCCAGATCTACAATAAAGATTTTGCCAAAGGCCATCATGGCAA
ACCGAATCTGCATACCCTGTATTGGACCGGTCTGTTTAGCCCTGAAAATCTGGCAAAAACCTCGATTAAACTGA
ATGGTCAGGCGGAACTGTTTTATCGTCCGAAAAAGCCGTATGAAACGTATGGCACATCGTCTGGGTGAAAAAA
TGCTGAACAAAAAACTGAAAGACCAGAAAACCCCGATCCCGGATACACTGTATCAAGAACTGTATGATTATGT
GAACCATCGTCTGAGCCATGATCTGAGTGATGAAGCACGTGCCCTGCTGCCGAATGTTATTACCAAAGAAGTT
AGCCACGAGATCATTAAAGATCGTCGTTTTACCAGCGACAAATTCTTTTTTCATGTGCCGATTACCCTGAATTAT
CAGGCAGCAAATAGCCCGAGCAAATTTAACCAGCGTGTTAATGCATATCTGAAAGAACATCCAGAAACGCCG
ATTATTGGTATTGATCGTGGTGAACGTAACCTGATTTATATCACCGTTATTGATAGCACCGGCAAAATCCTGGA
ACAGCGTAGCCTGAATACCATTCAGCAGTTTGATTACCAGAAAAACTGGATAATCGCGAGAAAGAACGTGT
TGCAGCACGTCAGGCATGGTCAGTTGTTGGTACAATTAAAGACCTGAAACAGGGTTATCTGAGCCAGGTTATT
CATGAAATTGTGGATCTGATGATTCACTATCAGGCCGTTGTTGTGCTGGAAAACCTGAATTTTGGCTTTAAAA
GCAAACGTACCGGCATTGCAGAAAAAGCAGTTTATCAGCAGTTCGAGAAAATGCTGATTGACAAACTGAATT
GCCTGGTGCTGAAAGATTATCCGGCTGAAAAAGTTGGTGGTGTTCTGAATCCGTATCAGCTGACCGATCAGTT
TACCAGCTTTGCAAAAATGGGCACCCAGAGCGGATTTCTGTTTTATGTTCCGGCACCGTATACGAGCAAATT
```

-continued

GATCCGCTGACCGGTTTTGTTGATCCGTTTGTTTGGAAAACCATCAAAAACCATGAAAGCCGCAAACATTTTCT

GGAAGGTTTCGATTTTCTGCATTACGACGTTAAAACGGGTGATTTCATCCTGCACTTTAAAATGAATCGCAATC

TGAGTTTTCAGCGTGGCCTGCCTGGTTTTATGCCTGCATGGGATATTGTGTTTGAGAAAAACGAAACACAGTT

CGATGCAAAAGGCACCCCGTTTATTGCAGGTAAACGTATTGTTCCGGTGATTGAAAATCATCGTTTCACCGGT

CGTTATCGCGATCTGTATCCGGCAAATGAACTGATCGCACTGCTGGAAGAGAAAGGTATTGTTTTTCGTGATG

GCTCAAACATTCTGCCGAAACTGCTGGAAAATGATGATAGCCATGCAATTGATACCATGGTTGCACTGATTCG

TAGCGTTCTGCAGATGCGTAATAGCAATGCAGCAACCGGTGAAGATTACATTAATAGTCCGGTTCGTGATCTG

AATGGTGTTTGTTTTGATAGCCGTTTTCAGAATCCGGAATGGCCGATGGATGCAGATGCAAATGGTGCATATC

ATATTGCACTGAAAGGACAGCTGCTGCTGAACCACCTGAAAGAAAGCAAAGATCTGAAACTGCAAAACGGCA

TTAGCAATCAGGATTGGCTGGCATATATCCAAGAACTGCGTAACGGTCGTAGCAGTGATGATGAAGCAACCG

CAGATAGCCAGCATGCAGCACCGCCTAAAAAGAAACGTAAAGTTGGTGGTAGCGGTGGTTCAGGTGGTAGT

GGCGGTAGTGGTGGCTCAGGGGGTTCTGGTGGCTCTGGTGGTAGCCTCGAGCACCACCACCACCACCACTGA

SEQ ID NO.: 13
ATGAGCAGTGATGATGAAGCAACCGCAGATAGCCAGCATGCAGCACCGCCTAAAAAGAAA

CGTAAAGTTGGTATCCACGGAGTCCCAGCAGCCACCCAGTTTGAAGGTTTCACCAATCTGTATCAGGTTAGCA

AAACCCTGCGTTTTGAACTGATTCCGCAGGGTAAAACCCTGAAACATATTCAAGAACAGGGCTTCATCGAAGA

GGATAAAGCACGTAACGATCACTACAAAGAACTGAAACCGATTATCGACCGCATCTATAAAACCTATGCAGAT

CAGTGTCTGCAGCTGGTTCAGCTGGATTGGGAAAATCTGAGCGCAGCAATTGATAGTTATCGCAAAGAAAAA

ACCGAAGAAACCCGTAATGCACTGATTGAAGAACAGGCAACCTATCGTAATGCCATCCATGATTATTTCATTG

GTCGTACCGATAATCTGACCGATGCAATTAACAAACGTCACGCCGAAATCTATAAAGGCCTGTTTAAAGCCGA

ACTGTTTAATGGCAAAGTTCTGAAACAGCTGGGCACCGTTACCACCACCGAACATGAAAATGCACTGCTGCGT

AGCTTTGATAAATTCACCACCTATTTCAGCGGCTTTTATGAGAATCGCAAAAACGTGTTTAGCGCAGAAGATAT

TAGCACCGCAATTCCGCATCGTATTGTGCAGGATAATTTCCCGAAATTCAAAGAGAACTGCCACATTTTTACCC

GTCTGATTACCGCAGTTCCGAGCCTGCGTGAACATTTTGAAAACGTTAAAAAAGCCATCGGCATCTTTGTTAGC

ACCAGCATTGAAGAAGTTTTTAGCTTCCCGTTTTACAATCAGCTGCTGACCCAGACCCAGATTGATCTGTATAA

CCAACTGCTGGGTGGTATTAGCCGTGAAGCAGGCACCGAAAAAATCAAAGGTCTGAATGAAGTGCTGAATCT

GGCCATTCAGAAAAATGATGAAACCGCACATATTATTGCAAGCCTGCCGCATCGTTTTATTCCGCTGTTCAAAC

AAATTCTGAGCGATCGTAATACCCTGAGCTTTATTCTGGAAGAATTCAAATCCGATGAAGAGGTGATTCAGAG

CTTTTGCAAATACAAAACGCTGCTGCGCAATGAAAATGTTCTGGAAACTGCCGAAGCACTGTTTAACGAACTG

AATAGCATTGATCTGACCCACATCTTTATCAGCCACAAAAACTGGAAACCATTTCAAGCGCACTGTGTGATCA

TTGGGATACCCTGCGTAATGCCCTGTATGAACGTCGTATTAGCGAACTGACCGGTAAAATTACCAAAAGCGCG

AAAGAAAAAGTTCAGCGCAGTCTGAAACATGAGGATATTAATCTGCAAGAGATTATTAGCGCAGCCGGTAAA

GAACTGTCAGAAGCATTTAAACAGAAAACCAGCGAAATTCTGTCACATGCACATGCAGCACTGGATCAGCCGC

TGCCGACCACCCTGAAAAAACAAGAAGAAAAAGAAATCCTGAAAAGCCAGCTGGATAGCCTGCTGGGTCTGT

ATCATCTGCTGGACTGGTTTGCAGTTGATGAAAGCAATGAAGTTGATCCGGAATTTAGCGCACGTCTGACCGG

CATTAAACTGGAAATGGAACCGAGCCTGAGCTTTTATAACAAAGCCCGTAATTATGCCACCAAAAAACCGTAT

AGCGTCGAAAAATTCAAACTGAACTTTCAGATGCCGACCCTGGCAAGCGGTTGGGATGTTAATAAAGAAAAA

AACAACGGTGCCATCCTGTTCGTGAAAAATGGCCTGTATTATCTGGGTATTATGCCGAAACAGAAAGGTCGTT

ATAAAGCGCTGAGCTTTGAACCGACGGAAAAAACCAGTGAAGGTTTTGATAAAATGTACTACGACTATTTTCC

GGATGCAGCCAAAATGATTCCGAAATGTAGCACCCAGCTGAAAGCAGTTACCGCACATTTTCAGACCCATACC

ACCCCGATTCTGCTGAGCAATAACTTTATTGAACCGCTGGAAATCACCAAAGAGATCTACGATCTGAATAACC

-continued

CGGAAAAAGAGCCGAAAAAATTCCAGACCGCATATGCAAAAAAACCGGTGATCAGAAAGGTTATCGTGAA
GCGCTGTGTAAATGGATTGATTTCACCCGTGATTTTCTGAGCAAATACACCAAAACCACCAGTATCGATCTGA
GCAGCCTGCGTCCGAGCAGCCAGTATAAAGATCTGGGCGAATATTATGCAGAACTGAATCCGCTGCTGTATCA
TATTAGCTTTCAGCGTATTGCCGAGAAAGAAATCATGGACGCAGTTGAAACCGGTAAACTGTACCTGTTCCAG
ATCTACAATAAAGATTTTGCCAAAGGCCATCATGGCAAACCGAATCTGCATACCCTGTATTGGACCGGTCTGTT
TAGCCCTGAAAATCTGGCAAAAACCTCGATTAAACTGAATGGTCAGGCGGAACTGTTTTATCGTCCGAAAAGC
CGTATGAAACGTATGGCACATCGTCTGGGTGAAAAAATGCTGAACAAAAAACTGAAAGACCAGAAAACCCCG
ATCCCGGATACACTGTATCAAGAACTGTATGATTATGTGAACCATCGTCTGAGCCATGATCTGAGTGATGAAG
CACGTGCCCTGCTGCCGAATGTTATTACCAAAGAAGTTAGCCACGAGATCATTAAAGATCGTCGTTTTACCAG
CGACAAATTCTTTTTTCATGTGCCGATTACCCTGAATTATCAGGCAGCAAATAGCCCGAGCAAATTTAACCAGC
GTGTTAATGCATATCTGAAAGAACATCCAGAAACGCCGATTATTGGTATTGATCGTGGTGAACGTAACCTGAT
TTATATCACCGTTATTGATAGCACCGGCAAAATCCTGGAACAGCGTAGCCTGAATACCATTCAGCAGTTTGATT
ACCAGAAAAAACTGGATAATCGCGAGAAGAACGTGTTGCAGCACGTCAGGCATGGTCAGTTGTTGGTACAA
TTAAAGACCTGAAACAGGGTTATCTGAGCCAGGTTATTCATGAAATTGTGGATCTGATGATTCACTATCAGGC
CGTTGTTGTGCTGGAAAACCTGAATTTTGGCTTTAAAAGCAAACGTACCGGCATTGCAGAAAAAGCAGTTTAT
CAGCAGTTCGAGAAAATGCTGATTGACAAACTGAATTGCCTGGTGCTGAAAGATTATCCGGCTGAAAAAGTT
GGTGGTGTTCTGAATCCGTATCAGCTGACCGATCAGTTTACCAGCTTTGCAAAAATGGGCACCCAGAGCGGAT
TTCTGTTTTATGTTCCGGCACCGTATACGAGCAAAATTGATCCGCTGACCGGTTTTGTTGATCCGTTTGTTTGG
AAAACCATCAAAAACCATGAAAGCCGCAAACATTTTCTGGAAGGTTTCGATTTTCTGCATTACGACGTTAAAAC
GGGTGATTTCATCCTGCACTTTAAAATGAATCGCAATCTGAGTTTTCAGCGTGGCCTGCCTGGTTTTATGCCTG
CATGGGATATTGTGTTTGAGAAAAACGAAACACAGTTCGATGCAAAAGGCACCCCGTTTATTGCAGGTAAAC
GTATTGTTCCGGTGATTGAAAATCATCGTTTCACCGGTCGTTATCGCGATCTGTATCCGGCAAATGAACTGATC
GCACTGCTGGAAGAGAAAGGTATTGTTTTTCGTGATGGCTCAAACATTCTGCCGAAACTGCTGGAAAATGATG
ATAGCCATGCAATTGATACCATGGTTGCACTGATTCGTAGCGTTCTGCAGATGCGTAATAGCAATGCAGCAAC
CGGTGAAGATTACATTAATAGTCCGGTTCGTGATCTGAATGGTGTTTGTTTTGATAGCCGTTTTCAGAATCCGG
AATGGCCGATGGATGCAGATGCAAATGGTGCATATCATATTGCACTGAAAGGACAGCTGCTGCTGAACCACC
TGAAAGAAAGCAAAGATCTGAAACTGCAAAACGGCATTAGCAATCAGGATTGGCTGGCATATATCCAAGAAC
TGCGTAACGGTCGTAGCAGTGATGATGAAGCAACCGCAGATAGCCAGCATGCAGCACCGCCTAAAAAGAAAC
GTAAAGTTGGTGGTAGCGGTGGTTCAGGTGGTAGTGGCGGTAGTGGTGGCTCAGGGGGTTCTGGTGGCTCT
GGTGGTAGCCTCGAGCACCACCACCACCACCACTGA

SEQ ID NO.: 14
ATGACCCAGTTTGAAGGTTTCACCAATCTGTATCAGGTTAGCAAAACCCTGCGTTTTGAACT
GATTCCGCAGGGTAAAACCCTGAAACATATTCAAGAACAGGGCTTCATCGAAGAGGATAAAGCACGTAACGA
TCACTACAAAGAACTGAAACCGATTATCGACCGCATCTATAAAACCTATGCAGATCAGTGTCTGCAGCTGGTT
CAGCTGGATTGGGAAAATCTGAGCGCAGCAATTGATAGTTATCGCAAAGAAAAACCGAAGAAACCCGTAAT
GCACTGATTGAAGAACAGGCAACCTATCGTAATGCCATCCATGATTATTTCATTGGTCGTACCGATAATCTGAC
CGATGCAATTAACAAACGTCACGCCGAAATCTATAAAGGCCTGTTTAAAGCCGAACTGTTTAATGGCAAAGTT
CTGAAACAGCTGGGCACCGTTACCACCACCGAACATGAAAATGCACTGCTGCGTAGCTTTGATAAAATTCACCA
CCTATTTCAGCGGCTTTTATGAGAATCGCAAAAACGTGTTTAGCGCAGAAGATATTAGCACCGCAATTCCGCA
TCGTATTGTGCAGGATAATTTCCCGAAATTCAAAGAGAACTGCCACATTTTTACCCGTCTGATTACCGCAGTTC
CGAGCCTGCGTGAACATTTTGAAAACGTTAAAAAAGCCATCGGCATCTTTGTTAGCACCAGCATTGAAGAAGT

-continued

```
TTTTAGCTTCCCGTTTTACAATCAGCTGCTGACCCAGACCCAGATTGATCTGTATAACCAACTGCTGGGTGGTA

TTAGCCGTGAAGCAGGCACCGAAAAAATCAAAGGTCTGAATGAAGTGCTGAATCTGGCCATTCAGAAAAATG

ATGAAACCGCACATATTATTGCAAGCCTGCCGCATCGTTTTATTCCGCTGTTCAAACAAATTCTGAGCGATCGT

AATACCCTGAGCTTTATTCTGGAAGAATTCAAATCCGATGAAGAGGTGATTCAGAGCTTTTGCAAATACAAAA

CGCTGCTGCGCAATGAAATGTTCTGGAAACTGCCGAAGCACTGTTTAACGAACTGAATAGCATTGATCTGAC

CCACATCTTTATCAGCCACAAAAAACTGGAAACCATTTCAAGCGCACTGTGTGATCATTGGGATACCCTGCGTA

ATGCCCTGTATGAACGTCGTATTAGCGAACTGACCGGTAAAATTACCAAAAGCGCGAAAGAAAAAGTTCAGC

GCAGTCTGAAACATGAGGATATTAATCTGCAAGAGATTATTAGCGCAGCCGGTAAAGAACTGTCAGAAGCAT

TTAAACAGAAAACCAGCGAAATTCTGTCACATGCACATGCAGCACTGGATCAGCCGCTGCCGACCACCCTGAA

AAAACAAGAAGAAAAAGAAATCCTGAAAAGCCAGCTGGATAGCCTGCTGGGTCTGTATCATCTGCTGGACTG

GTTTGCAGTTGATGAAAGCAATGAAGTTGATCCGGAATTTAGCGCACGTCTGACCGGCATTAAACTGGAAAT

GGAACCGAGCCTGAGCTTTTATAACAAAGCCCGTAATTATGCCACCAAAAAACCGTATAGCGTCGAAAAATTC

AAACTGAACTTTCAGATGCCGACCCTGGCAAGCGGTTGGGATGTTAATAAAGAAAAAAACAACGGTGCCATC

CTGTTCGTGAAAAATGGCCTGTATTATCTGGGTATTATGCCGAAACAGAAAGGTCGTTATAAAGCGCTGAGCT

TTGAACCGACGGAAAAAACCAGTGAAGGTTTTGATAAAATGTACTACGACTATTTTCCGGATGCAGCCAAAAT

GATTCCGAAATGTAGCACCCAGCTGAAAGCAGTTACCGCACATTTTCAGACCCATACCACCCCGATTCTGCTGA

GCAATAACTTTATTGAACCGCTGGAAATCACCAAAGAGATCTACGATCTGAATAACCCGGAAAAAGAGCCGA

AAAAATTCCAGACCGCATATGCAAAAAAAACCGGTGATCAGAAAGGTTATCGTGAAGCGCTGTGTAAATGGA

TTGATTTCACCCGTGATTTTCTGAGCAAATACACCAAAACCACCAGTATCGATCTGAGCAGCCTGCGTCCGAGC

AGCCAGTATAAAGATCTGGGCGAATATTATGCAGAACTGAATCCGCTGCTGTATCATATTAGCTTTCAGCGTA

TTGCCGAGAAAGAAATCATGGACGCAGTTGAAACCGGTAAACTGTACCTGTTCCAGATCTACAATAAAGATTT

TGCCAAAGGCCATCATGGCAAACCGAATCTGCATACCCTGTATTGGACCGGTCTGTTTAGCCCTGAAAATCTG

GCAAAAACCTCGATTAAACTGAATGGTCAGGCGGAACTGTTTTATCGTCCGAAAAGCCGTATGAAACGTATG

GCACATCGTCTGGGTGAAAAATGCTGAACAAAAAACTGAAAGACCAGAAAACCCCGATCCCGGATACACTG

TATCAAGAACTGTATGATTATGTGAACCATCGTCTGAGCCATGATCTGAGTGATGAAGCACGTGCCCTGCTGC

CGAATGTTATTACCAAAGAAGTTAGCCACGAGATCATTAAAGATCGTCGTTTTACCAGCGACAAATTCTTTTTT

CATGTGCCGATTACCCTGAATTATCAGGCAGCAAATAGCCCGAGCAAATTTAACCAGCGTGTTAATGCATATC

TGAAAGAACATCCAGAAACGCCGATTATTGGTATTGATCGTGGTGAACGTAACCTGATTTATATCACCGTTATT

GATAGCACCGGCAAAATCCTGGAACAGCGTAGCCTGAATACCATTCAGCAGTTTGATTACCAGAAAAAACTG

GATAATCGCGAGAAAGAACGTGTTGCAGCACGTCAGGCATGGTCAGTTGTTGGTACAATTAAAGACCTGAAA

CAGGGTTATCTGAGCCAGGTTATTCATGAAATTGTGGATCTGATGATTCACTATCAGGCCGTTGTTGTGCTGG

AAAACCTGAATTTTGGCTTTAAAAGCAAACGTACCGGCATTGCAGAAAAAGCAGTTTATCAGCAGTTCGAGAA

AATGCTGATTGACAAACTGAATTGCCTGGTGCTGAAAGATTATCCGGCTGAAAAAGTTGGTGGTGTTCTGAAT

CCGTATCAGCTGACCGATCAGTTTACCAGCTTTGCAAAAATGGGCACCCAGAGCGGATTTCTGTTTTATGTTCC

GGCACCGTATACGAGCAAAATTGATCCGCTGACCGGTTTTGTTGATCCGTTTGTTTGGAAAACCATCAAAAAC

CATGAAAGCCGCAAACATTTTCTGGAAGGTTTCGATTTTCTGCATTACGACGTTAAAACGGGTGATTTCATCCT

GCACTTTAAAATGAATCGCAATCTGAGTTTTTCAGCGTGGCCTGCCTGGTTTTATGCCTGCATGGGATATTGTGT

TTGAGAAAAACGAAACACAGTTCGATGCAAAAGGCACCCCGTTTATTGCAGGTAAACGTATTGTTCCGGTGAT

TGAAAATCATCGTTTCACCGGTCGTTATCGCGATCTGTATCCGGCAAATGAACTGATCGCACTGCTGGAAGAG

AAAGGTATTGTTTTCGTGATGGCTCAAACATTCTGCCGAAACTGCTGGAAAATGATGATAGCCATGCAATTG

ATACCATGGTTGCACTGATTCGTAGCGTTCTGCAGATGCGTAATAGCAATGCAGCAACCGGTGAAGATTACAT
```

-continued

```
TAATAGTCCGGTTCGTGATCTGAATGGTGTTTGTTTTGATAGCCGTTTTCAGAATCCGGAATGGCCGATGGAT
GCAGATGCAAATGGTGCATATCATATTGCACTGAAAGGACAGCTGCTGCTGAACCACCTGAAAGAAAGCAAA
GATCTGAAACTGCAAAACGGCATTAGCAATCAGGATTGGCTGGCATATATCCAAGAACTGCGTAACGGTCGT
AAACGTCCGGCAGCAACCAAAAAAGCAGGTCAGGCAAAAAAGAAAAAAGGTGGTAGCGGTGGTTCAGGTG
GTAGTGGCGGTAGTGGTGGCTCAGGGGGTTCTGGTGGCTCTGGTGGTAGCCTCGAGCACCACCACCACCACC
ACTGA
```

SEQ ID NO.: 15
```
ATGACCCAGTTTGAAGGTTTCACCAATCTGTATCAGGTTAGCAAAACCCTGCGTTTTGAACT
GATTCCGCAGGGTAAAACCCTGAAACATATTCAAGAACAGGGCTTCATCGAAGAGGATAAAGCACGTAACGA
TCACTACAAAGAACTGAAACCGATTATCGACCGCATCTATAAAACCTATGCAGATCAGTGTCTGCAGCTGGTT
CAGCTGGATTGGGAAAATCTGAGCGCAGCAATTGATAGTTATCGCAAAGAAAAAACCGAAGAAACCCGTAAT
GCACTGATTGAAGAACAGGCAACCTATCGTAATGCCATCCATGATTATTTCATTGGTCGTACCGATAATCTGAC
CGATGCAATTAACAAACGTCACGCCGAAATCTATAAAGGCCTGTTTAAAGCCGAACTGTTTAATGGCAAAGTT
CTGAAACAGCTGGGCACCGTTACCACCACCGAACATGAAAATGCACTGCTGCGTAGCTTTGATAAATTCACCA
CCTATTTCAGCGGCTTTTATGAGAATCGCAAAAACGTGTTTAGCGCAGAAGATATTAGCACCGCAATTCCGCA
TCGTATTGTGCAGGATAATTTCCCGAAATTCAAAGAGAACTGCCACATTTTTACCCGTCTGATTACCGCAGTTC
CGAGCCTGCGTGAACATTTTGAAAACGTTAAAAAAGCCATCGGCATCTTTGTTAGCACCAGCATTGAAGAAGT
TTTTAGCTTCCCGTTTTACAATCAGCTGCTGACCCAGACCCAGATTGATCTGTATAACCAACTGCTGGGTGGTA
TTAGCCGTGAAGCAGGCACCGAAAAAATCAAAGGTCTGAATGAAGTGCTGAATCTGGCCATTCAGAAAAATG
ATGAAACCGCACATATTATTGCAAGCCTGCCGCATCGTTTTATTCCGCTGTTCAAACAAATTCTGAGCGATCGT
AATACCCTGAGCTTTATTCTGGAAGAATTCAAATCCGATGAAGAGGTGATTCAGAGCTTTTGCAAATACAAAA
CGCTGCTGCGCAATGAAAATGTTCTGGAAACTGCCGAAGCACTGTTTAACGAACTGAATAGCATTGATCTGAC
CCACATCTTTATCAGCCACAAAAAACTGGAAACCATTTCAAGCGCACTGTGTGATCATTGGGATACCCTGCGTA
ATGCCCTGTATGAACGTCGTATTAGCGAACTGACCGGTAAAATTACCAAAAGCGCGAAAGAAAAAGTTCAGC
GCAGTCTGAAACATGAGGATATTAATCTGCAAGAGATTATTAGCGCAGCCGGTAAAGAACTGTCAGAAGCAT
TTAAACAGAAAACCAGCGAAATTCTGTCACATGCACATGCAGCACTGGATCAGCCGCTGCCGACCACCCTGAA
AAAACAAGAAGAAAAGAAATCCTGAAAAGCCAGCTGGATAGCCTGCTGGGTCTGTATCATCTGCTGGACTG
GTTTGCAGTTGATGAAAGCAATGAAGTTGATCCGGAATTTAGCGCACGTCTGACCGGCATTAAACTGGAAAT
GGAACCGAGCCTGAGCTTTTATAACAAAGCCCGTAATTATGCCACCAAAAAACCGTATAGCGTCGAAAAATTC
AAACTGAACTTTCAGATGCCGACCCTGGCAAGCGGTTGGGATGTTAATAAAGAAAAAAACAACGGTGCCATC
CTGTTCGTGAAAAATGGCCTGTATTATCTGGGTATTATGCCGAAACAGAAAGGTCGTTATAAAGCGCTGAGCT
TTGAACCGACGGAAAAAACCAGTGAAGGTTTTGATAAAATGTACTACGACTATTTTCCGGATGCAGCCAAAAT
GATTCCGAAATGTAGCACCCAGCTGAAAGCAGTTACCGCACATTTTCAGACCCATACCACCCCGATTCTGCTGA
GCAATAACTTTATTGAACCGCTGGAAATCACCAAAGAGATCTACGATCTGAATAACCCGGAAAAAGAGCCGA
AAAAATTCCAGACCGCATATGCAAAAAAACCGGTGATCAGAAAGGTTATCGTGAAGCGCTGTGTAAATGGA
TTGATTTCACCCGTGATTTTCTGAGCAAATACACCAAAACCACCAGTATCGATCTGAGCAGCCTGCGTCCGAGC
AGCCAGTATAAAGATCTGGGCGAATATTATGCAGAACTGAATCCGCTGCTGTATCATATTAGCTTTCAGCGTA
TTGCCGAGAAAGAAATCATGGACGCAGTTGAAACCGGTAAACTGTACCTGTTCCAGATCTACAATAAAGATTT
TGCCAAAGGCCATCATGGCAAACCGAATCTGCATACCCTGTATTGGACCGGTCTGTTTAGCCCTGAAAATCTG
GCAAAAACCTCGATTAAACTGAATGGTCAGGCGGAACTGTTTTATCGTCCGAAAAGCCGTATGAAACGTATG
GCACATCGTCTGGGTGAAAAAATGCTGAACAAAAAACTGAAAGACCAGAAAACCCCGATCCCGGATACACTG
```

-continued

TATCAAGAACTGTATGATTATGTGAACCATCGTCTGAGCCATGATCTGAGTGATGAAGCACGTGCCCTGCTGC

CGAATGTTATTACCAAAGAAGTTAGCCACGAGATCATTAAAGATCGTCGTTTTACCAGCGACAAATTCTTTTTT

CATGTGCCGATTACCCTGAATTATCAGGCAGCAAATAGCCCGAGCAAATTTAACCAGCGTGTTAATGCATATC

TGAAAGAACATCCAGAAACGCCGATTATTGGTATTGATCGTGGTGAACGTAACCTGATTTATATCACCGTTATT

GATAGCACCGGCAAAATCCTGGAACAGCGTAGCCTGAATACCATTCAGCAGTTTGATTACCAGAAAAAACTG

GATAATCGCGAGAAGAACGTGTTGCAGCACGTCAGGCATGGTCAGTTGTTGGTACAATTAAAGACCTGAAA

CAGGGTTATCTGAGCCAGGTTATTCATGAAATTGTGGATCTGATGATTCACTATCAGGCCGTTGTTGTGCTGG

AAAACCTGAATTTTGGCTTTAAAAGCAAACGTACCGGCATTGCAGAAAAAGCAGTTTATCAGCAGTTCGAGAA

AATGCTGATTGACAAACTGAATTGCCTGGTGCTGAAAGATTATCCGGCTGAAAAAGTTGGTGGTGTTCTGAAT

CCGTATCAGCTGACCGATCAGTTTACCAGCTTTGCAAAAATGGGCACCCAGAGCGGATTTCTGTTTTATGTTCC

GGCACCGTATACGAGCAAAATTGATCCGCTGACCGGTTTTGTTGATCCGTTTGTTTGGAAAACCATCAAAAAC

CATGAAAGCCGCAAACATTTTCTGGAAGGTTTCGATTTTCTGCATTACGACGTTAAAACGGGTGATTTCATCCT

GCACTTTAAAATGAATCGCAATCTGAGTTTTCAGCGTGGCCTGCCTGGTTTTATGCCTGCATGGGATATTGTGT

TTGAGAAAAACGAAACACAGTTCGATGCAAAAGGCACCCCGTTTATTGCAGGTAAACGTATTGTTCCGGTGAT

TGAAAATCATCGTTTCACCGGTCGTTATCGCGATCTGTATCCGGCAAATGAACTGATCGCACTGCTGGAAGAG

AAAGGTATTGTTTTCGTGATGGCTCAAACATTCTGCCGAAACTGCTGGAAAATGATGATAGCCATGCAATTG

ATACCATGGTTGCACTGATTCGTAGCGTTCTGCAGATGCGTAATAGCAATGCAGCAACCGGTGAAGATTACAT

TAATAGTCCGGTTCGTGATCTGAATGGTGTTTGTTTTGATAGCCGTTTTCAGAATCCGGAATGGCCGATGGAT

GCAGATGCAAATGGTGCATATCATATTGCACTGAAAGGACAGCTGCTGCTGAACCACCTGAAAGAAAGCAAA

GATCTGAAACTGCAAAACGGCATTAGCAATCAGGATTGGCTGGCATATATCCAAGAACTGCGTAACGGTCGT

AAACGTACCGCAGATGGTAGCGAATTTGAAAGCCCGAAAAAAAAGCGTAAGGTGGAAGGTGGTAGCGGTGG

TTCAGGTGGTAGTGGCGGTAGTGGTGGCTCAGGGGGTTCTGGTGGCTCTGGTGGTAGCCTCGAGCACCACCA

CCACCACCACTGA

SEQ ID NO.: 16

ATGACCCAGTTTGAAGGTTTCACCAATCTGTATCAGGTTAGCAAAACCCTGCGTTTTGAACT

GATTCCGCAGGGTAAAACCCTGAAACATATTCAAGAACAGGGCTTCATCGAAGAGGATAAAGCACGTAACGA

TCACTACAAAGAACTGAAACCGATTATCGACCGCATCTATAAAACCTATGCAGATCAGTGTCTGCAGCTGGTT

CAGCTGGATTGGGAAAATCTGAGCGCAGCAATTGATAGTTATCGCAAAGAAAAACCGAAGAAACCCGTAAT

GCACTGATTGAAGAACAGGCAACCTATCGTAATGCCATCCATGATTATTTCATTGGTCGTACCGATAATCTGAC

CGATGCAATTAACAAACGTCACGCCGAAATCTATAAAGGCCTGTTTAAAGCCGAACTGTTTAATGGCAAAGTT

CTGAAACAGCTGGGCACCGTTACCACCACCGAACATGAAAATGCACTGCTGCGTAGCTTTGATAAAATTCACCA

CCTATTTCAGCGGCTTTTATGAGAATCGCAAAAACGTGTTTAGCGCAGAAGATATTAGCACCGCAATTCCGCA

TCGTATTGTGCAGGATAATTTCCCGAAATTCAAAGAGAACTGCCACATTTTTACCCGTCTGATTACCGCAGTTC

CGAGCCTGCGTGAACATTTTGAAAACGTTAAAAAAGCCATCGGCATCTTTGTTAGCACCAGCATTGAAGAAGT

TTTTAGCTTCCCGTTTTACAATCAGCTGCTGACCCAGACCCAGATTGATCTGTATAACCAACTGCTGGGTGGTA

TTAGCCGTGAAGCAGGCACCGAAAAAATCAAAGGTCTGAATGAAGTGCTGAATCTGGCCATTCAGAAAAATG

ATGAAACCGCACATATTATTGCAAGCCTGCCGCATCGTTTTATTCCGCTGTTCAAACAAATTCTGAGCGATCGT

AATACCCTGAGCTTTATTCTGGAAGAATTCAAATCCGATGAAGAGGTGATTCAGAGCTTTTGCAAATACAAAA

CGCTGCTGCGCAATGAAAATGTTCTGGAAACTGCCGAAGCACTGTTTAACGAACTGAATAGCATTGATCTGAC

CCACATCTTTATCAGCCACAAAAAACTGGAAACCATTTCAAGCGCACTGTGTGATCATTGGGATACCCTGCGTA

ATGCCCTGTATGAACGTCGTATTAGCGAACTGACCGGTAAAATTACCAAAAGCGCGAAAGAAAAAGTTCAGC

-continued

```
GCAGTCTGAAACATGAGGATATTAATCTGCAAGAGATTATTAGCGCAGCCGGTAAAGAACTGTCAGAAGCAT

TTAAACAGAAAACCAGCGAAATTCTGTCACATGCACATGCAGCACTGGATCAGCCGCTGCCGACCACCCTGAA

AAAACAAGAAGAAAAGAAATCCTGAAAAGCCAGCTGGATAGCCTGCTGGGTCTGTATCATCTGCTGGACTG

GTTTGCAGTTGATGAAAGCAATGAAGTTGATCCGGAATTTAGCGCACGTCTGACCGGCATTAAACTGGAAAT

GGAACCGAGCCTGAGCTTTTATAACAAAGCCCGTAATTATGCCACCAAAAAACCGTATAGCGTCGAAAAATTC

AAACTGAACTTTCAGATGCCGACCCTGGCAAGCGGTTGGGATGTTAATAAAGAAAAAAACAACGGTGCCATC

CTGTTCGTGAAAAATGGCCTGTATTATCTGGGTATTATGCCGAAACAGAAAGGTCGTTATAAAGCGCTGAGCT

TTGAACCGACGGAAAAAACCAGTGAAGGTTTTGATAAAATGTACTACGACTATTTTCCGGATGCAGCCAAAAT

GATTCCGAAATGTAGCACCCAGCTGAAAGCAGTTACCGCACATTTTCAGACCCATACCACCCCGATTCTGCTGA

GCAATAACTTTATTGAACCGCTGGAAATCACCAAAGAGATCTACGATCTGAATAACCCGGAAAAAGAGCCGA

AAAAATTCCAGACCGCATATGCAAAAAAACCGGTGATCAGAAAGGTTATCGTGAAGCGCTGTGTAAATGGA

TTGATTTCACCCGTGATTTTCTGAGCAAATACACCAAAACCACCAGTATCGATCTGAGCAGCCTGCGTCCGAGC

AGCCAGTATAAAGATCTGGGCGAATATTATGCAGAACTGAATCCGCTGCTGTATCATATTAGCTTTCAGCGTA

TTGCCGAGAAAGAAATCATGGACGCAGTTGAAACCGGTAAACTGTACCTGTTCCAGATCTACAATAAAGATTT

TGCCAAAGGCCATCATGGCAAACCGAATCTGCATACCCTGTATTGGACCGGTCTGTTTAGCCCTGAAAATCTG

GCAAAAACCTCGATTAAACTGAATGGTCAGGCGGAACTGTTTTATCGTCCGAAAAGCCGTATGAAACGTATG

GCACATCGTCTGGGTGAAAAAATGCTGAACAAAAACTGAAAGACCAGAAAACCCCGATCCCGGATACACTG

TATCAAGAACTGTATGATTATGTGAACCATCGTCTGAGCCATGATCTGAGTGATGAAGCACGTGCCCTGCTGC

CGAATGTTATTACCAAAGAAGTTAGCCACGAGATCATTAAAGATCGTCGTTTTACCAGCGACAAATTCTTTTTT

CATGTGCCGATTACCCTGAATTATCAGGCAGCAAATAGCCCGAGCAAATTTAACCAGCGTGTTAATGCATATC

TGAAAGAACATCCAGAAACGCCGATTATTGGTATTGATCGTGGTGAACGTAACCTGATTTATATCACCGTTATT

GATAGCACCGGCAAAATCCTGGAACAGCGTAGCCTGAATACCATTCAGCAGTTTGATTACCAGAAAAAACTG

GATAATCGCGAGAAGAACGTGTTGCAGCACGTCAGGCATGGTCAGTTGTTGGTACAATTAAAGACCTGAAA

CAGGGTTATCTGAGCCAGGTTATTCATGAAATTGTGGATCTGATGATTCACTATCAGGCCGTTGTTGTGCTGG

AAAACCTGAATTTTGGCTTTAAAAGCAAACGTACCGGCATTGCAGAAAAAGCAGTTTATCAGCAGTTCGAGAA

AATGCTGATTGACAAACTGAATTGCCTGGTGCTGAAAGATTATCCGGCTGAAAAAGTTGGTGGTGTTCTGAAT

CCGTATCAGCTGACCGATCAGTTTACCAGCTTTGCAAAAATGGGCACCCAGAGCGGATTTCTGTTTTATGTTCC

GGCACCGTATACGAGCAAAATTGATCCGCTGACCGGTTTTGTTGATCCGTTTGTTTGGAAAACCATCAAAAAC

CATGAAAGCCGCAAACATTTTCTGGAAGGTTTCGATTTTCTGCATTACGACGTTAAAACGGGTGATTTCATCCT

GCACTTTAAAATGAATCGCAATCTGAGTTTTCAGCGTGGCCTGCCTGGTTTTATGCCTGCATGGGATATTGTGT

TTGAGAAAAACGAAACACAGTTCGATGCAAAAGGCACCCCGTTTATTGCAGGTAAACGTATTGTTCCGGTGAT

TGAAAATCATCGTTTCACCGGTCGTTATCGCGATCTGTATCCGGCAAATGAACTGATCGCACTGCTGGAAGAG

AAAGGTATTGTTTTCGTGATGGCTCAAACATTCTGCCGAAACTGCTGGAAAATGATGATAGCCATGCAATTG

ATACCATGGTTGCACTGATTCGTAGCGTTCTGCAGATGCGTAATAGCAATGCAGCAACCGGTGAAGATTACAT

TAATAGTCCGGTTCGTGATCTGAATGGTGTTTGTTTTGATAGCCGTTTTCAGAATCCGGAATGGCCGATGGAT

GCAGATGCAAATGGTGCATATCATATTGCACTGAAAGGACAGCTGCTGCTGAACCACCTGAAAGAAAGCAAA

GATCTGAAACTGCAAAACGGCATTAGCAATCAGGATTGGCTGGCATATATCCAAGAACTGCGTAACGGTCGT

AGCAGTGATGATGAAGCAACCGCAGATAGCCAGCATGCAGCACCGCCTAAAAAGAAACGTAAAGTTGGTGG
```

-continued

TAGCGGCGGTAGTAAACGTACCGCAGATGGTAGCGAATTTGAAAGCCCGAAAAAAAAGCGTAAGGTGGAAG

GTGGTAGCGGTGGTTCAGGTGGTAGTGGCGGTAGTGGTGGCTCAGGGGGTTCTGGTGGCTCTGGTGGTAGC

CTCGAGCACCACCACCACCACCACTGA

SEQ ID NO.: 17

ATGACCCAGTTTGAAGGTTTCACCAATCTGTATCAGGTTAGCAAAACCCTGCGTTTTGAACT

GATTCCGCAGGGTAAAACCCTGAAACATATTCAAGAACAGGGCTTCATCGAAGAGGATAAAGCACGTAACGA

TCACTACAAAGAACTGAAACCGATTATCGACCGCATCTATAAAACCTATGCAGATCAGTGTCTGCAGCTGGTT

CAGCTGGATTGGGAAAATCTGAGCGCAGCAATTGATAGTTATCGCAAAGAAAAAACCGAAGAAACCCGTAAT

GCACTGATTGAAGAACAGGCAACCTATCGTAATGCCATCCATGATTATTTCATTGGTCGTACCGATAATCTGAC

CGATGCAATTAACAAACGTCACGCCGAAATCTATAAAGGCCTGTTTAAAGCCGAACTGTTTAATGGCAAAGTT

CTGAAACAGCTGGGCACCGTTACCACCACCGAACATGAAAATGCACTGCTGCGTAGCTTTGATAAATTCACCA

CCTATTTCAGCGGCTTTTATGAGAATCGCAAAAACGTGTTTAGCGCAGAAGATATTAGCACCGCAATTCCGCA

TCGTATTGTGCAGGATAATTTCCCGAAATTCAAAGAGAACTGCCACATTTTTACCCGTCTGATTACCGCAGTTC

CGAGCCTGCGTGAACATTTTGAAAACGTTAAAAAAGCCATCGGCATCTTTGTTAGCACCAGCATTGAAGAAGT

TTTTAGCTTCCCGTTTTACAATCAGCTGCTGACCCAGACCCAGATTGATCTGTATAACCAACTGCTGGGTGGTA

TTAGCCGTGAAGCAGGCACCGAAAAAATCAAGGTCTGAATGAAGTGCTGAATCTGGCCATTCAGAAAAATG

ATGAAACCGCACATATTATTGCAAGCCTGCCGCATCGTTTTATTCCGCTGTTCAAACAAATTCTGAGCGATCGT

AATACCCTGAGCTTTATTCTGGAAGAATTCAAATCCGATGAAGAGGTGATTCAGAGCTTTTGCAAATACAAAA

CGCTGCTGCGCAATGAAAATGTTCTGGAAACTGCCGAAGCACTGTTTAACGAACTGAATAGCATTGATCTGAC

CCACATCTTTATCAGCCACAAAAAACTGGAAACCATTTCAAGCGCACTGTGTGATCATTGGGATACCCTGCGTA

ATGCCCTGTATGAACGTCGTATTAGCGAACTGACCGGTAAAATTACCAAAAGCGCGAAAGAAAAAGTTCAGC

GCAGTCTGAAACATGAGGATATTAATCTGCAAGAGATTATTAGCGCAGCCGGTAAAGAACTGTCAGAAGCAT

TTAAACAGAAAACCAGCGAAATTCTGTCACATGCACATGCAGCACTGGATCAGCCGCTGCCGACCACCCTGAA

AAAACAAGAAGAAAAGAAATCCTGAAAAGCCAGCTGGATAGCCTGCTGGGTCTGTATCATCTGCTGGACTG

GTTTGCAGTTGATGAAAGCAATGAAGTTGATCCGGAATTTAGCGCACGTCTGACCGGCATTAAACTGGAAAT

GGAACCGAGCCTGAGCTTTTATAACAAAGCCCGTAATTATGCCACCAAAAAACCGTATAGCGTCGAAAAATTC

AAACTGAACTTTCAGATGCCGACCCTGGCAAGCGGTTGGGATGTTAATAAAGAAAAAAACAACGGTGCCATC

CTGTTCGTGAAAAATGGCCTGTATTATCTGGGTATTATGCCGAAACAGAAAGGTCGTTATAAAGCGCTGAGCT

TTGAACCGACGGAAAAAACCAGTGAAGGTTTTGATAAAATGTACTACGACTATTTTCCGGATGCAGCCAAAAT

GATTCCGAAATGTAGCACCCAGCTGAAAGCAGTTACCGCACATTTTCAGACCCATACCACCCCGATTCTGCTGA

GCAATAACTTTATTGAACCGCTGGAAATCACCAAAGAGATCTACGATCTGAATAACCCGGAAAAAGAGCCGA

AAAAATTCCAGACCGCATATGCAAAAAAACCGGTGATCAGAAAGGTTATCGTGAAGCGCTGTGTAAATGGA

TTGATTTCACCCGTGATTTTCTGAGCAAATACACCAAAACCACCAGTATCGATCTGAGCAGCCTGCGTCCGAGC

AGCCAGTATAAAGATCTGGGCGAATATTATGCAGAACTGAATCCGCTGCTGTATCATATTAGCTTTCAGCGTA

TTGCCGAGAAAGAAATCATGGACGCAGTTGAAACCGGTAAACTGTACCTGTTCCAGATCTACAATAAAGATTT

TGCCAAAGGCCATCATGGCAAACCGAATCTGCATACCCTGTATTGGACCGGTCTGTTTAGCCCTGAAAATCTG

GCAAAAACCTCGATTAAACTGAATGGTCAGGCGGAACTGTTTTATCGTCCGAAAAGCCGTATGAAACGTATG

GCACATCGTCTGGGTGAAAAAATGCTGAACAAAAAACTGAAAGACCAGAAAACCCCGATCCCGGATACACTG

TATCAAGAACTGTATGATTATGTGAACCATCGTCTGAGCCATGATCTGAGTGATGAAGCACGTGCCCTGCTGC

CGAATGTTATTACCAAAGAAGTTAGCCACGAGATCATTAAAGATCGTCGTTTTACCAGCGACAAATTCTTTTTT

CATGTGCCGATTACCCTGAATTATCAGGCAGCAAATAGCCCGAGCAAATTTAACCAGCGTGTTAATGCATATC

-continued

```
TGAAAGAACATCCAGAAACGCCGATTATTGGTATTGATCGTGGTGAACGTAACCTGATTTATATCACCGTTATT
GATAGCACCGGCAAAATCCTGGAACAGCGTAGCCTGAATACCATTCAGCAGTTTGATTACCAGAAAAAACTG
GATAATCGCGAGAAAGAACGTGTTGCAGCACGTCAGGCATGGTCAGTTGTTGGTACAATTAAAGACCTGAAA
CAGGGTTATCTGAGCCAGGTTATTCATGAAATTGTGGATCTGATGATTCACTATCAGGCCGTTGTTGTGCTGG
AAAACCTGAATTTTGGCTTTAAAAGCAAACGTACCGGCATTGCAGAAAAAGCAGTTTATCAGCAGTTCGAGAA
AATGCTGATTGACAAACTGAATTGCCTGGTGCTGAAAGATTATCCGGCTGAAAAAGTTGGTGGTGTTCTGAAT
CCGTATCAGCTGACCGATCAGTTTACCAGCTTTGCAAAAATGGGCACCCAGAGCGGATTTCTGTTTTATGTTCC
GGCACCGTATACGAGCAAAATTGATCCGCTGACCGGTTTTGTTGATCCGTTTGTTTGGAAAACCATCAAAAAC
CATGAAAGCCGCAAACATTTTCTGGAAGGTTTCGATTTTCTGCATTACGACGTTAAAACGGGTGATTTCATCCT
GCACTTTAAAATGAATCGCAATCTGAGTTTTCAGCGTGGCCTGCCTGGTTTTATGCCTGCATGGGATATTGTGT
TTGAGAAAAACGAAACACAGTTCGATGCAAAAGGCACCCCGTTTATTGCAGGTAAACGTATTGTTCCGGTGAT
TGAAAATCATCGTTTCACCGGTCGTTATCGCGATCTGTATCCGGCAAATGAACTGATCGCACTGCTGGAAGAG
AAAGGTATTGTTTTTCGTGATGGCTCAAACATTCTGCCGAAACTGCTGGAAAATGATGATAGCCATGCAATTG
ATACCATGGTTGCACTGATTCGTAGCGTTCTGCAGATGCGTAATAGCAATGCAGCAACCGGTGAAGATTACAT
TAATAGTCCGGTTCGTGATCTGAATGGTGTTTGTTTTGATAGCCGTTTTCAGAATCCGGAATGGCCGATGGAT
GCAGATGCAAATGGTGCATATCATATTGCACTGAAAGGACAGCTGCTGCTGAACCACCTGAAAGAAAGCAAA
GATCTGAAACTGCAAAACGGCATTAGCAATCAGGATTGGCTGGCATATATCCAAGAACTGCGTAACGGTCGT
AAACGTCCGGCAGCAACCAAAAAAGCAGGTCAGGCAAAAAAGAAAAAAGGTGGTAGCGGCGGTAGTAAAC
GTACCGCAGATGGTAGCGAATTTGAAAGCCCGAAAAAAAAGCGTAAGGTGGAAGGTGGTAGCGGTGGTTCA
GGTGGTAGTGGCGGTAGTGGTGGCTCAGGGGGTTCTGGTGGCTCTGGTGGTAGCCTCGAGCACCACCACCA
CCACCACTGA
```

The following amino acid sequences of preferred Cas12a polypeptides are depicted below.

SEQ ID NO.: 18
MGSSSSGLVPRGSHMASMTGGQQMGRDPGKPIPNPLLGLDSTAPKKKRKV
GIHGVPAATQFEGFTNLYQVSKTLRFELIPQGKTLKHIQEQGFIEEDKAR
NDHYKELKPIIDRIYKTYADQCLQLVQLDWENLSAAIDSYRKEKTEETRN
ALIEEQATYRNAIHDYFIGRTDNLTDAINKRHAEIYKGLFKAELFNGKVL
KQLGTVTTTEHENALLRSFDKFTTYFSGFYENRKNVFSAEDISTAIPHRI
VQDNFPKFKENCHIFTRLITAVPSLREHFENVKKAIGIFVSTSIEEVFSF
PFYNQLLTQTQIDLYNQLLGGISREAGTEKIKGLNEVLNLAIQKNDETAH
IIASLPHRFIPLFKQILSDRNTLSFILEEFKSDEEVIQSFCKYKTLLRNE
NVLETAEALFNELNSIDLTHIFISHKKLETISSALCDHWDTLRNALYERR
ISELTGKITKSAKEKVQRSLKHEDINLQEIISAAGKELSEAFKQKTSEIL
SHAHAALDQPLPTTLKKQEEKEILKSQLDSLLGLYHLLDWFAVDESNEVD
PEFSARLTGIKLEMEPSLSFYNKARNYATKKPYSVEKFKLNFQMPTLASG
WDVNKEKNNGAILFVKNGLYYLGIMPKQKGRYKALSFEPTEKTSEGFDKM
YYDYFPDAAKMIPKCSTQLKAVTAHFQTHTTPILLSNNFIEPLEITKEIY
DLNNPEKEPKKFQTAYAKKTGDQKGYREALCKWIDFTRDFLSKYTKTTSI
DLSSLRPSSQYKDLGEYYAELNPLLYHISFQRIAEKEIMDAVETGKLYLF
QIYNKDFAKGHHGKPNLHTLYWTGLFSPENLAKTSIKLNGQAELFYRPKS
RMKRMAHRLGEKMLNKKLKDQKTPIPDTLYQELYDYVNHRLSHDLSDEAR
ALLPNVITKEVSHEIIKDRRFTSDKFFFHVPITLNYQAANSPSKFNQRVN
AYLKEHPETPIIGIDRGERNLIYITVIDSTGKILEQRSLNTIQQFDYQKK
LDNREKERVAARQAWSVVGTIKDLKQGYLSQVIHEIVDLMIHYQAVVVLE
NLNFGFKSKRTGIAEKAVYQQFEKMLIDKLNCLVLKDYPAEKVGGVLNPY
QLTDQFTSFAKMGTQSGFLFYVPAPYTSKIDPLTGFVDPFVWKTIKNHES
RKHFLEGFDFLHYDVKTGDFILHFKMNRNLSFQRGLPGFMPAWDIVFEKN
ETQFDAKGTPPFIAGKRIVPVIENHRFTGRYRDLYPANELIALLEEKGIVF
RDGSNILPKLLENDDSHAIDTMVALIRSVLQMRNSNAATGEDYINSPVRD
LNGVCFDSRFQNPEWPMDADANGAYHIALKGQLLLNHLKESKDLKLQNGI
SNQDWLAYIQELRNPKKKRKVKLAAALEHHHHHH

SEQ ID NO.: 19
MGSSSSGLVPRGSHMASMTGGQQMGRDPAPKKKRKVGIHGVPAATQFEGF
TNLYQVSKTLRFELIPQGKTLKHIQEQGFIEEDKARNDHYKELKPIIDRI
YKTYADQCLQLVQLDWENLSAAIDSYRKEKTEETRNALIEEQATYRNAIH
DYFIGRTDNLTDAINKRHAEIYKGLFKAELFNGKVLKQLGTVTTTEHENA
LLRSFDKFTTYFSGFYENRKNVFSAEDISTAIPHRIVQDNFPKFKENCHI

FTRLITAVPSLREHFENVKKAIGIFVSTSIEEVFSFPFYNQLLTQTQIDL
YNQLLGGISREAGTEKIKGLNEVLNLAIQKNDETAHIIASLPHRFIPLFK
QILSDRNTLSFILEEFKSDEEVIQSFCKYKTLLRNENVLETAEALFNELN
SIDLTHIFISHKKLETISSALCDHWDTLRNALYERRISELTGKITKSAKE
KVQRSLKHEDINLQEIISAAGKELSEAFKQKTSEILSHAHAALDQPLPTT
LKKQEEKEILKSQLDSLLGLYHLLDWFAVDESNEVDPEFSARLTGIKLEM
EPSLSFYNKARNYATKKPYSVEKFKLNFQMPTLASGWDVNKEKNNGAILF
VKNGLYYLGIMPKQKGRYKALSFEPTEKTSEGFDKMYYDYFPDAAKMIPK
CSTQLKAVTAHFQTHTTPILLSNNFIEPLEITKEIYDLNNPEKEPKKFQT
AYAKKTGDQKGYREALCKWIDFTRDFLSKYTKTTSIDLSSLRPSSQYKDL
GEYYAELNPLLYHISFQRIAEKEIMDAVETGKLYLFQIYNKDFAKGHHGK
PNLHTLYWTGLFSPENLAKTSIKLNGQAELFYRPKSRMKRMAHRLGEKML
NKKLKDQKTPIPDTLYQELYDYVNHRLSHDLSDEARALLPNVITKEVSHE
IIKDRRFTSDKFFFHVPITLNYQAANSPSKFNQRVNAYLKEHPETPIIGI
DRGERNLIYITVIDSTGKILEQRSLNTIQQFDYQKKLDNREKERVAARQA
WSVVGTIKDLKQGYLSQVIHEIVDLMIHYQAVVVLENLNFGFKSKRTGIA
EKAVYQQFEKMLIDKLNCLVLKDYPAEKVGGVLNPYQLTDQFTSFAKMGT
QSGFLFYVPAPYTSKIDPLTGFVDPFVWKTIKNHESRKHFLEGFDFLHYD
VKTGDFILHFKMNRNLSFQRGLPGFMPAWDIVFEKNETQFDAKGTPFIAG
KRIVPVIENHRFTGRYRDLYPANELIALLEEKGIVFRDGSNILPKLLEND
DSHAIDTMVALIRSVLQMRNSNAATGEDYINSPVRDLNGVCFDSRFQNPE
WPMDADANGAYHIALKGQLLLNHLKESKDLKLQNGISNQDWLAYIQELRN
PKKKRKVKLAAALEHHHHHH

SEQ ID NO.: 20
MPKKKRKVGIHGVPAATQFEGFTNLYQVSKTLRFELIPQGKTLKHIQEQG
FIEEDKARNDHYKELKPIIDRIYKTYADQCLQLVQLDWENLSAAIDSYRK
EKTEETRNALIEEQATYRNAIHDYFIGRTDNLTDAINKRHAEIYKGLFKA
ELFNGKVLKQLGTVTTTEHENALLRSFDKFTTYFSGFYENRKNVFSAEDI
STAIPHRIVQDNFPKFKENCHIFTRLITAVPSLREHFENVKKAIGIFVST
SIEEVFSFPFYNQLLTQTQIDLYNQLLGGISREAGTEKIKGLNEVLNLAI
QKNDETAHIIASLPHRFIPLFKQILSDRNTLSFILEEFKSDEEVIQSFCK
YKTLLRNENVLETAEALFNELNSIDLTHIFISHKKLETISSALCDHWDTL
RNALYERRISELTGKITKSAKEKVQRSLKHEDINLQEIISAAGKELSEAF
KQKTSEILSHAHAALDQPLPTTLKKQEEKEILKSQLDSLLGLYHLLDWFA
VDESNEVDPEFSARLTGIKLEMEPSLSFYNKARNYATKKPYSVEKFKLNF
QMPTLASGWDVNKEKNNGAILFVKNGLYYLGIMPKQKGRYKALSFEPTEK
TSEGFDKMYYDYFPDAAKMIPKCSTQLKAVTAHFQTHTTPILLSNNFIEP
LEITKEIYDLNNPEKEPKKFQTAYAKKTGDQKGYREALCKWIDFTRDFLS
KYTKTTSIDLSSLRPSSQYKDLGEYYAELNPLLYHISFQRIAEKEIMDAV
ETGKLYLFQIYNKDFAKGHHGKPNLHTLYWTGLFSPENLAKTSIKLNGQA
ELFYRPKSRMKRMAHRLGEKMLNKKLKDQKTPIPDTLYQELYDYVNHRLS
HDLSDEARALLPNVITKEVSHEIIKDRRFTSDKFFFHVPITLNYQAANSP
SKFNQRVNAYLKEHPETPIIGIDRGERNLIYITVIDSTGKILEQRSLNTI
QQFDYQKKLDNREKERVAARQAWSVVGTIKDLKQGYLSQVIHEIVDLMIH
YQAVVVLENLNFGFKSKRTGIAEKAVYQQFEKMLIDKLNCLVLKDYPAEK
VGGVLNPYQLTDQFTSFAKMGTQSGFLFYVPAPYTSKIDPLTGFVDPFVW
KTIKNHESRKHFLEGFDFLHYDVKTGDFILHFKMNRNLSFQRGLPGFMPA
WDIVFEKNETQFDAKGTPFIAGKRIVPVIENHRFTGRYRDLYPANELIAL
LEEKGIVFRDGSNILPKLLENDDSHAIDTMVALIRSVLQMRNSNAATGED
YINSPVRDLNGVCFDSRFQNPEWPMDADANGAYHIALKGQLLLNHLKESK
DLKLQNGISNQDWLAYIQELRNPKKKRKVLEHHHHHH

SEQ ID NO.: 21
MTQFEGFTNLYQVSKTLRFELIPQGKTLKHIQEQGFIEEDKARNDHYKEL
KPIIDRIYKTYADQCLQLVQLDWENLSAAIDSYRKEKTEETRNALIEEQA
TYRNAIHDYFIGRTDNLTDAINKRHAEIYKGLFKAELFNGKVLKQLGTVT
TTEHENALLRSFDKFTTYFSGFYENRKNVFSAEDISTAIPHRIVQDNFPK
FKENCHIFTRLITAVPSLREHFENVKKAIGIFVSTSIEEVFSFPFYNQLL
TQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAE
ALFNELNSIDLTHIFISHKKLETISSALCDHWDTLRNALYERRISELTGK
ITKSAKEKVQRSLKHEDINLQEIISAAGKELSEAFKQKTSEILSHAHAAL
DQPLPTTLKKQEEKEILKSQLDSLLGLYHLLDWFAVDESNEVDPEFSARL
TGIKLEMEPSLSFYNKARNYATKKPYSVEKFKLNFQMPTLASGWDVNKEK
NNGAILFVKNGLYYLGIMPKQKGRYKALSFEPTEKTSEGFDKMYYDYFPD
AAKMIPKCSTQLKAVTAHFQTHTTPILLSNNFIEPLEITKEIYDLNNPEK
EPKKFQTAYAKKTGDQKGYREALCKWIDFTRDFLSKYTKTTSIDLSSLRP
SSQYKDLGEYYAELNPLLYHISFQRIAEKEIMDAVETGKLYLFQIYNKDF
AKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVI
TKEVSHEIIKDRRFTSDKFFFHVPITLNYQAANSPSKFNQRVNAYLKEHP
ETPIIGIDRGERNLIYITVIDSTGKILEQRSLNTIQQFDYQKKLDNREKE
RVAARQAWSVVGTIKDLKQGYLSQVIHEIVDLMIHYQAVVVLENLNFGFK
SKRTGIAEKAVYQQFEKMLIDKLNCLVLKDYPAEKVGGVLNPYQLTDQFT
SFAKMGTQSGFLFYVPAPYTSKIDPLTGFVDPFVWKTIKNHESRKHFLEG
FDFLHYDVKTGDFILHFKMNRNLSFQRGLPGFMPAWDIVFEKNETQFDAK
GTPFIAGKRIVPVIENHRFTGRYRDLYPANELIALLEEKGIVFRDGSNIL
PKLLENDDSHAIDTMVALIRSVLQMRNSNAATGEDYINSPVRDLNGVCFD
SRFQNPEWPMDADANGAYHIALKGQLLLNHLKESKDLKLQNGISNQDWLA
YIQELRNPKKKRKVLEHHHHHH

SEQ ID NO.: 22
MGSSHHHHHHSSGLVPRGSHMASMTGGQQMGRDPTQFEGFTNLYQVSKTL
RFELIPQGKTLKHIQEQGFIEEDKARNDHYKELKPIIDRIYKTYADQCLQ

-continued

LVQLDWENLSAAIDSYRKEKTEETRNALIEEQATYRNAIHDYFIGRTDNL
TDAINKRHAEIYKGLFKAELFNGKVLKQLGTVTTTEHENALLRSFDKFTT
YFSGFYENRKNVFSAEDISTAIPHRIVQDNFPKFKENCHIFTRLITAVPS
LREHFENVKKAIGIFVSTSIEEVFSFPFYNQLLTQTQIDLYNQLLGGISR
EAGTEKIKGLNEVLNLAIQKNDETAHIIASLPHRFIPLFKQILSDRNTLS
FILEEFKSDEEVIQSFCKYKTLLRNENVLETAEALFNELNSIDLTHIFIS
HKKLETISSALCDHWDTLRNALYERRISELTGKITKSAKEKVQRSLKHED
INLQEIISAAGKELSEAFKQKTSEILSHAHAALDQPLPTTLKKQEEKEIL
KSQLDSLLGLYHLLDWFAVDESNEVDPEFSARLTGIKLEMEPSLSFYNKA
RNYATKKPYSVEKFKLNFQMPTLASGWDVNKEKNNGAILFVKNGLYYLGI
MPKQKGRYKALSFEPTEKTSEGFDKMYYDYFPDAAKMIPKCSTQLKAVTA
HFQTHTTPILLSNNFIEPLEITKEIYDLNNPEKEPKKFQTAYAKKTGDQK
GYREALCKWIDFTRDFLSKYTKTTSIDLSSLRPSSQYKDLGEYYAELNPL
LYHISFQRIAEKEIMDAVETGKLYLFQIYNKDFAKGHHGKPNLHTLYWTG
LFSPENLAKTSIKLNGQAELFYRPKSRMKRMAHRLGEKMLNKKLKDQKTP
IPDTLYQELYDYVNHRLSHDLSDEARALLPNVITKEVSHEIIKDRRFTSD
KFFFHVPITLNYQAANSPSKFNQRVNAYLKEHPETPIIGIDRGERNLIYI
TVIDSTGKILEQRSLNTIQQFDYQKKLDNREKERVAARQAWSVVGTIKDL
KQGYLSQVIHEIVDLMIHYQAVVVLENLNFGFKSKRTGIAEKAVYQQFEK
MLIDKLNCLVLKDYPAEKVGGVLNPYQLTDQFTSFAKMGTQSGFLFYVPA
PYTSKIDPLTGFVDPFVWKTIKNHESRKHFLEGFDFLHYDVKTGDFILHF
KMNRNLSFQRGLPGFMPAWDIVFEKNETQFDAKGTPFIAGKRIVPVIENH
RFTGYRDLYPANELIALLEEKGIVFRDGSNILPKLLENDDSHAIDTMVA
LIRSVLQMRNSNAATGEDYINSPVRDLNGVCFDSRFQNPEWPMDADANGA
YHIALKGQLLLNHLKESKDLKLQNGISNQDWLAYIQELRNGRSSDDEATA
DSQHAAPPKKKRKVGGSGGSGGSGGSGGSGGSGGSLEHHHHHH

SEQ ID NO.: 23

MTQFEGFTNLYQVSKTLRFELIPQGKTLKHIQEQGFIEEDKARNDHYKEL
KPIIDRIYKTYADQCLQLVQLDWENLSAAIDSYRKEKTEETRNALIEEQA
TYRNAIHDYFIGRTDNLTDAINKRHAEIYKGLFKAELFNGKVLKQLGTVT
TTEHENALLRSFDKFTTYFSGFYENRKNVFSAEDISTAIPHRIVQDNFPK
FKENCHIFTRLITAVPSLREHFENVKKAIGIFVSTSIEEVFSFPFYNQLL
TQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAE
ALFNELNSIDLTHIFISHKKLETISSALCDHWDTLRNALYERRISELTGK
ITKSAKEKVQRSLKHEDINLQEIISAAGKELSEAFKQKTSEILSHAHAAL
DQPLPTTLKKQEEKEILKSQLDSLLGLYHLLDWFAVDESNEVDPEFSARL
TGIKLEMEPSLSFYNKARNYATKKPYSVEKFKLNFQMPTLASGWDVNKEK
NNGAILFVKNGLYYLGIMPKQKGRYKALSFEPTEKTSEGFDKMYYDYFPD
AAKMIPKCSTQLKAVTAHFQTHTTPILLSNNFIEPLEITKEIYDLNNPEK
EPKKFQTAYAKKTGDQKGYREALCKWIDFTRDFLSKYTKTTSIDLSSLRP

SSQYKDLGEYYAELNPLLYHISFQRIAEKEIMDAVETGKLYLFQIYNKDF
AKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVI
TKEVSHEIIKDRRFTSDKFFFHVPITLNYQAANSPSKFNQRVNAYLKEHP
ETPIIGIDRGERNLIYITVIDSTGKILEQRSLNTIQQFDYQKKLDNREKE
RVAARQAWSVVGTIKDLKQGYLSQVIHEIVDLMIHYQAVVVLENLNFGFK
SKRTGIAEKAVYQQFEKMLIDKLNCLVLKDYPAEKVGGVLNPYQLTDQFT
SFAKMGTQSGFLFYVPAPYTSKIDPLTGFVDPFVWKTIKNHESRKHFLEG
FDFLHYDVKTGDFILHFKMNRNLSFQRGLPGFMPAWDIVFEKNETQFDAK
GTPFIAGKRIVPVIENHRFTGYRDLYPANELIALLEEKGIVFRDGSNIL
PKLLENDDSHAIDTMVALIRSVLQMRNSNAATGEDYINSPVRDLNGVCFD
SRFQNPEWPMDADANGAYHIALKGQLLLNHLKESKDLKLQNGISNQDWLA
YIQELRNGRSSDDEATADSQHAAPPKKKRKVGGSGGSGGSGGSGGSGGSG
GSGGSLEHHHHHH

SEQ ID NO.: 24

MGSSSSGLVPRGSHMASMTGGQQMGRDPTQFEGFTNLYQVSKTLRFELIP
QGKTLKHIQEQGFIEEDKARNDHYKELKPIIDRIYKTYADQCLQLVQLDW
ENLSAAIDSYRKEKTEETRNALIEEQATYRNAIHDYFIGRTDNLTDAINK
RHAEIYKGLFKAELFNGKVLKQLGTVTTTEHENALLRSFDKFTTYFSGFY
ENRKNVFSAEDISTAIPHRIVQDNFPKFKENCHIFTRLITAVPSLREHFE
NVKKAIGIFVSTSIEEVFSFPFYNQLLTQTQIDLYNQLLGGISREAGTEK
IKGLNEVLNLAIQKNDETAHIIASLPHRFIPLFKQILSDRNTLSFILEEF
KSDEEVIQSFCKYKTLLRNENVLETAEALFNELNSIDLTHIFISHKKLET
ISSALCDHWDTLRNALYERRISELTGKITKSAKEKVQRSLKHEDINLQEI
ISAAGKELSEAFKQKTSEILSHAHAALDQPLPTTLKKQEEKEILKSQLDS
LLGLYHLLDWFAVDESNEVDPEFSARLTGIKLEMEPSLSFYNKARNYATK
KPYSVEKFKLNFQMPTLASGWDVNKEKNNGAILFVKNGLYYLGIMPKQKG
RYKALSFEPTEKTSEGFDKMYYDYFPDAAKMIPKCSTQLKAVTAHFQTHT
TPILLSNNFIEPLEITKEIYDLNNPEKEPKKFQTAYAKKTGDQKGYREAL
CKWIDFTRDFLSKYTKTTSIDLSSLRPSSQYKDLGEYYAELNPLLYHISF
QRIAEKEIMDAVETGKLYLFQIYNKDFAKGHHGKPNLHTLYWTGLFSPEN
LAKTSIKLNGQAELFYRPKSRMKRMAHRLGEKMLNKKLKDQKTPIPDTLY
QELYDYVNHRLSHDLSDEARALLPNVITKEVSHEIIKDRRFTSDKFFFHV
PITLNYQAANSPSKFNQRVNAYLKEHPETPIIGIDRGERNLIYITVIDST
GKILEQRSLNTIQQFDYQKKLDNREKERVAARQAWSVVGTIKDLKQGYLS
QVIHEIVDLMIHYQAVVVLENLNFGFKSKRTGIAEKAVYQQFEKMLIDKL
NCLVLKDYPAEKVGGVLNPYQLTDQFTSFAKMGTQSGFLFYVPAPYTSKI
DPLTGFVDPFVWKTIKNHESRKHFLEGFDFLHYDVKTGDFILHFKMNRNL
SFQRGLPGFMPAWDIVFEKNETQFDAKGTPFIAGKRIVPVIENHRFTGRY
RDLYPANELIALLEEKGIVFRDGSNILPKLLENDDSHAIDTMVALIRSVL
QMRNSNAATGEDYINSPVRDLNGVCFDSRFQNPEWPMDADANGAYHIALK

-continued
GQLLLNHLKESKDLKLQNGISNQDWLAYIQELRNGRSSDDEATADSQHAA
PPKKKRKVGGSGGSGGSGGSGGSGGSGGSGGSLEHHHHHH SEQ ID NO.: 25
MPPPKRPRLDGIHGVPAATQFEGFTNLYQVSKTLRFELIPQGKTLKHIQE
QGFIEEDKARNDHYKELKPIIDRIYKTYADQCLQLVQLDWENLSAAIDSY
RKEKTEETRNALIEEQATYRNAIHDYFIGRTDNLTDAINKRHAEIYKGLF
KAELFNGKVLKQLGTVTTTEHENALLRSFDKFTTYFSGFYENRKNVFSAE
DISTAIPHRIVQDNFPKFKENCHIFTRLITAVPSLREHFENVKKAIGIFV
STSIEEVFSFPFYNQLLTQTQIDLYNQLLGGISREAGTEKIKGLNEVLNL
AIQKNDETAHIIASLPHRFIPLFKQILSDRNTLSFILEEFKSDEEVIQSF
CKYKTLLRNENVLETAEALFNELNSIDLTHIFISHKKLETISSALCDHWD
TLRNALYERRISELTGKITKSAKEKVQRSLKHEDINLQEIISAAGKELSE
AFKQKTSEILSHAHAALDQPLPTTLKKQEEKEILKSQLDSLLGLYHLLDW
FAVDESNEVDPEFSARLTGIKLEMEPSLSFYNKARNYATKKPYSVEKFKL
NFQMPTLASGWDVNKEKNNGAILFVKNGLYYLGIMPKQKGRYKALSFEPT
EKTSEGFDKMYYDYFPDAAKMIPKCSTQLKAVTAHFQTHTTPILLSNNFI
EPLEITKEIYDLNNPEKEPKKFQTAYAKKTGDQKGYREALCKWIDFTRDF
LSKYTKTTSIDLSSLRPSSQYKDLGEYYAELNPLLYHISFQRIAEKEIMD
AVETGKLYLFQIYNKDFAKGHHGKPNLHTLYWTGLFSPENLAKTSIKLNG
QAELFYRPKSRMKRMAHRLGEKMLNKKLKDQKTPIPDTLYQELYDYVNHR
LSHDLSDEARALLPNVITKEVSHEIIKDRRFTSDKFFFHVPITLNYQAAN
SPSKFNQRVNAYLKEHPETPIIGIDRGERNLIYITVIDSTGKILEQRSLN
TIQQFDYQKKLDNREKERVAARQAWSVVGTIKDLKQGYLSQVIHEIVDLM
IHYQAVVVLENLNFGFKSKRTGIAEKAVYQQFEKMLIDKLNCLVLKDYPA
EKVGGVLNPYQLTDQFTSFAKMGTQSGFLFYVPAPYTSKIDPLTGFVDPF
VWKTIKNHESRKHFLEGFDFLHYDVKTGDFILHFKMNRNLSFQRGLPGFM
PAWDIVFEKNETQFDAKGTPFIAGKRIVPVIENHRFTGRYRDLYPANELI
ALLEEKGIVFRDGSNILPKLLENDDSHAIDTMVALIRSVLQMRNSNAATG
EDYINSPVRDLNGVCFDSRFQNPEWPMDADANGAYHIALKGQLLLNHLKE
SKDLKLQNGISNQDWLAYIQELRNGRSSDDEATADSQHAAPPKKKRKVGG
SGGSGGSGGSGGSGGSGGSLEHHHHHH SEQ ID NO.: 26
MSSDDEATADSQHAAPPKKKRKVGIHGVPAATQFEGFTNLYQVSKTLRFE
LIPQGKTLKHIQEQGFIEEDKARNDHYKELKPIIDRIYKTYADQCLQLVQ
LDWENLSAAIDSYRKEKTEETRNALIEEQATYRNAIHDYFIGRTDNLTDA
INKRHAEIYKGLFKAELFNGKVLKQLGTVTTTEHENALLRSFDKFTTYFS
GFYENRKNVFSAEDISTAIPHRIVQDNFPKFKENCHIFTRLITAVPSLRE
HFENVKKAIGIFVSTSIEEVFSFPFYNQLLTQTQIDLYNQLLGGISREAG
TEKIKGLNEVLNLAIQKNDETAHIIASLPHRFIPLFKQILSDRNTLSFIL
EEFKSDEEVIQSFCKYKTLLRNENVLETAEALFNELNSIDLTHIFISHKK
LETISSALCDHWDTLRNALYERRISELTGKITKSAKEKVQRSLKHEDINL
QEIISAAGKELSEAFKQKTSEILSHAHAALDQPLPTTLKKQEEKEILKSQ
LDSLLGLYHLLDWFAVDESNEVDPEFSARLTGIKLEMEPSLSFYNKARNY
ATKKPYSVEKFKLNFQMPTLASGWDVNKEKNNGAILFVKNGLYYLGIMPK
QKGRYKALSFEPTEKTSEGFDKMYYDYFPDAAKMIPKCSTQLKAVTAHFQ
THTTPILLSNNFIEPLEITKEIYDLNNPEKEPKKFQTAYAKKTGDQKGYR
EALCKWIDFTRDFLSKYTKTTSIDLSSLRPSSQYKDLGEYYAELNPLLYH
ISFQRIAEKEIMDAVETGKLYLFQIYNKDFAKGHHGKPNLHTLYWTGLFS
PENLAKTSIKLNGQAELFYRPKSRMKRMAHRLGEKMLNKKLKDQKTPIPD
TLYQELYDYVNHRLSHDLSDEARALLPNVITKEVSHEIIKDRRFTSDKFF
FHVPITLNYQAANSPSKFNQRVNAYLKEHPETPIIGIDRGERNLIYITVI
DSTGKILEQRSLNTIQQFDYQKKLDNREKERVAARQAWSVVGTIKDLKQG
YLSQVIHEIVDLMIHYQAVVVLENLNFGFKSKRTGIAEKAVYQQFEKMLI
DKLNCLVLKDYPAEKVGGVLNPYQLTDQFTSFAKMGTQSGFLFYVPAPYT
SKIDPLTGFVDPFVWKTIKNHESRKHFLEGFDFLHYDVKTGDFILHFKMN
RNLSFQRGLPGFMPAWDIVFEKNETQFDAKGTPFIAGKRIVPVIENHRFT
GRYRDLYPANELIALLEEKGIVFRDGSNILPKLLENDDSHAIDTMVALIR
SVLQMRNSNAATGEDYINSPVRDLNGVCFDSRFQNPEWPMDADANGAYHI
ALKGQLLLNHLKESKDLKLQNGISNQDWLAYIQELRNGRSSDDEATADSQ
HAAPPKKKRKVGGSGGSGGSGGSGGSGGSGGSLEHHHHHH SEQ ID NO.: 27
MTQFEGFTNLYQVSKTLRFELIPQGKTLKHIQEQGFIEEDKARNDHYKEL
KPIIDRIYKTYADQCLQLVQLDWENLSAAIDSYRKEKTEETRNALIEEQA
TYRNAIHDYFIGRTDNLTDAINKRHAEIYKGLFKAELFNGKVLKQLGTVT
TTEHENALLRSFDKFTTYFSGFYENRKNVFSAEDISTAIPHRIVQDNFPK
FKENCHIFTRLITAVPSLREHFENVKKAIGIFVSTSIEEVFSFPFYNQLL
TQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAE
ALFNELNSIDLTHIFISHKKLETISSALCDHWDTLRNALYERRISELTGK
ITKSAKEKVQRSLKHEDINLQEIISAAGKELSEAFKQKTSEILSHAHAAL
DQPLPTTLKKQEEKEILKSQLDSLLGLYHLLDWFAVDESNEVDPEFSARL
TGIKLEMEPSLSFYNKARNYATKKPYSVEKFKLNFQMPTLASGWDVNKEK
NNGAILFVKNGLYYLGIMPKQKGRYKALSFEPTEKTSEGFDKMYYDYFPD
AAKMIPKCSTQLKAVTAHFQTHTTPILLSNNFIEPLEITKEIYDLNNPEK
EPKKFQTAYAKKTGDQKGYREALCKWIDFTRDFLSKYTKTTSIDLSSLRP
SSQYKDLGEYYAELNPLLYHISFQRIAEKEIMDAVETGKLYLFQIYNKDF
AKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVI
TKEVSHEIIKDRRFTSDKFFFHVPITLNYQAANSPSKFNQRVNAYLKEHP
ETPIIGIDRGERNLIYITVIDSTGKILEQRSLNTIQQFDYQKKLDNREKE
RVAARQAWSVVGTIKDLKQGYLSQVIHEIVDLMIHYQAVVVLENLNFGFK
SKRTGIAEKAVYQQFEKMLIDKLNCLVLKDYPAEKVGGVLNPYQLTDQFT
SFAKMGTQSGFLFYVPAPYTSKIDPLTGFVDPFVWKTIKNHESRKHFLEG -continued FDFLHYDVKTGDFILHFKMNRNLSFQRGLPGFMPAWDIVFEKNETQFDAK
GTPFIAGKRIVPVIENHRFTGRYRDLYPANELIALLEEKGIVFRDGSNIL
PKLLENDDSHAIDTMVALIRSVLQMRNSNAATGEDYINSPVRDLNGVCFD
SRFQNPEWPMDADANGAYHIALKGQLLLNHLKESKDLKLQNGISNQDWLA
YIQELRNGRKRPAATKKAGQAKKKKGGSGSGSGGSGGSGGSGSGGSGGSL
EHHHHHH SEQ ID NO.: 28
MTQFEGFTNLYQVSKTLRFELIPQGKTLKHIQEQGFIEEDKARNDHYKEL
KPIIDRIYKTYADQCLQLVQLDWENLSAAIDSYRKEKTEETRNALIEEQA
TYRNAIHDYFIGRTDNLTDAINKRHAEIYKGLFKAELFNGKVLKQLGTVT
TTEHENALLRSFDKFTTYFSGFYENRKNVFSAEDISTAIPHRIVQDNFPK
FKENCHIFTRLITAVPSLREHFENVKKAIGIFVSTSIEEVFSFPFYNQLL
TQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAE
ALFNELNSIDLTHIFISHKKLETISSALCDHWDTLRNALYERRISELTGK
ITKSAKEKVQRSLKHEDINLQEIISAAGKELSEAFKQKTSEILSHAHAAL
DQPLPTTLKKQEEKEILKSQLDSLLGLYHLLDWFAVDESNEVDPEFSARL
TGIKLEMEPSLSFYNKARNYATKKPYSVEKFKLNFQMPTLASGWDVNKEK
NNGAILFVKNGLYYLGIMPKQKGRYKALSFEPTEKTSEGFDKMYYDYFPD
AAKMIPKCSTQLKAVTAHFQTHTTPILLSNNFIEPLEITKEIYDLNNPEK
EPKKFQTAYAKKTGDQKGYREALCKWIDFTRDFLSKYTKTTSIDLSSLRP
SSQYKDLGEYYAELNPLLYHISFQRIAEKEIMDAVETGKLYLFQIYNKDF
AKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVI
TKEVSHEIIKDRRFTSDKFFFHVPITLNYQAANSPSKFNQRVNAYLKEHP
ETPIIGIDRGERNLIYITVIDSTGKILEQRSLNTIQQFDYQKKLDNREKE
RVAARQAWSVVGTIKDLKQGYLSQVIHEIVDLMIHYQAVVVLENLNFGFK
SKRTGIAEKAVYQQFEKMLIDKLNCLVLKDYPAEKVGGVLNPYQLTDQFT
SFAKMGTQSGFLFYVPAPYTSKIDPLTGFVDPFVWKTIKNHESRKHFLEG
FDFLHYDVKTGDFILHFKMNRNLSFQRGLPGFMPAWDIVFEKNETQFDAK
GTPFIAGKRIVPVIENHRFTGRYRDLYPANELIALLEEKGIVFRDGSNIL
PKLLENDDSHAIDTMVALIRSVLQMRNSNAATGEDYINSPVRDLNGVCFD
SRFQNPEWPMDADANGAYHIALKGQLLLNHLKESKDLKLQNGISNQDWLA
YIQELRNGRKRTADGSEFESPKKKRKVEGGSGGSGGSGGSGGSGGSGGSG
GSLEHHHHHH SEQ ID NO.: 29
MTQFEGFTNLYQVSKTLRFELIPQGKTLKHIQEQGFIEEDKARNDHYKEL
KPIIDRIYKTYADQCLQLVQLDWENLSAAIDSYRKEKTEETRNALIEEQA
TYRNAIHDYFIGRTDNLTDAINKRHAEIYKGLFKAELFNGKVLKQLGTVT
TTEHENALLRSFDKFTTYFSGFYENRKNVFSAEDISTAIPHRIVQDNFPK
FKENCHIFTRLITAVPSLREHFENVKKAIGIFVSTSIEEVFSFPFYNQLL
TQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAE
ALFNELNSIDLTHIFISHKKLETISSALCDHWDTLRNALYERRISELTGK
ITKSAKEKVQRSLKHEDINLQEIISAAGKELSEAFKQKTSEILSHAHAAL
DQPLPTTLKKQEEKEILKSQLDSLLGLYHLLDWFAVDESNEVDPEFSARL
TGIKLEMEPSLSFYNKARNYATKKPYSVEKFKLNFQMPTLASGWDVNKEK
NNGAILFVKNGLYYLGIMPKQKGRYKALSFEPTEKTSEGFDKMYYDYFPD
AAKMIPKCSTQLKAVTAHFQTHTTPILLSNNFIEPLEITKEIYDLNNPEK
EPKKFQTAYAKKTGDQKGYREALCKWIDFTRDFLSKYTKTTSIDLSSLRP
SSQYKDLGEYYAELNPLLYHISFQRIAEKEIMDAVETGKLYLFQIYNKDF
AKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVI
TKEVSHEIIKDRRFTSDKFFFHVPITLNYQAANSPSKFNQRVNAYLKEHP
ETPIIGIDRGERNLIYITVIDSTGKILEQRSLNTIQQFDYQKKLDNREKE
RVAARQAWSVVGTIKDLKQGYLSQVIHEIVDLMIHYQAVVVLENLNFGFK
SKRTGIAEKAVYQQFEKMLIDKLNCLVLKDYPAEKVGGVLNPYQLTDQFT
SFAKMGTQSGFLFYVPAPYTSKIDPLTGFVDPFVWKTIKNHESRKHFLEG
FDFLHYDVKTGDFILHFKMNRNLSFQRGLPGFMPAWDIVFEKNETQFDAK
GTPFIAGKRIVPVIENHRFTGRYRDLYPANELIALLEEKGIVFRDGSNIL
PKLLENDDSHAIDTMVALIRSVLQMRNSNAATGEDYINSPVRDLNGVCFD
SRFQNPEWPMDADANGAYHIALKGQLLLNHLKESKDLKLQNGISNQDWLA
YIQELRNGRSSDDEATADSQHAAPPKKKRKVGGSGGSKRTADGSEFESPK
KKRKVEGGSGGSGGSGGSGGSGGSGGSGGSLEHHHHHH SEQ ID NO.: 30
MTQFEGFTNLYQVSKTLRFELIPQGKTLKHIQEQGFIEEDKARNDHYKEL
KPIIDRIYKTYADQCLQLVQLDWENLSAAIDSYRKEKTEETRNALIEEQA
TYRNAIHDYFIGRTDNLTDAINKRHAEIYKGLFKAELFNGKVLKQLGTVT
TTEHENALLRSFDKFTTYFSGFYENRKNVFSAEDISTAIPHRIVQDNFPK
FKENCHIFTRLITAVPSLREHFENVKKAIGIFVSTSIEEVFSFPFYNQLL
TQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAE
ALFNELNSIDLTHIFISHKKLETISSALCDHWDTLRNALYERRISELTGK
ITKSAKEKVQRSLKHEDINLQEIISAAGKELSEAFKQKTSEILSHAHAAL
DQPLPTTLKKQEEKEILKSQLDSLLGLYHLLDWFAVDESNEVDPEFSARL
TGIKLEMEPSLSFYNKARNYATKKPYSVEKFKLNFQMPTLASGWDVNKEK
NNGAILFVKNGLYYLGIMPKQKGRYKALSFEPTEKTSEGFDKMYYDYFPD
AAKMIPKCSTQLKAVTAHFQTHTTPILLSNNFIEPLEITKEIYDLNNPEK
EPKKFQTAYAKKTGDQKGYREALCKWIDFTRDFLSKYTKTTSIDLSSLRP
SSQYKDLGEYYAELNPLLYHISFQRIAEKEIMDAVETGKLYLFQIYNKDF
AKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVI -continued

TKEVSHEIIKDRRFTSDKFFFHVPITLNYQAANSPSKFNQRVNAYLKEHP

ETPIIGIDRGERNLIYITVIDSTGKILEQRSLNTIQQFDYQKKLDNREKE

RVAARQAWSVVGTIKDLKQGYLSQVIHEIVDLMIHYQAVVVLENLNFGFK

SKRTGIAEKAVYQQFEKMLIDKLNCLVLKDYPAEKVGGVLNPYQLTDQFT

SFAKMGTQSGFLFYVPAPYTSKIDPLTGFVDPFVWKTIKNHESRKHFLEG

FDFLHYDVKTGDFILHFKMNRNLSFQRGLPGFMPAWDIVFEKNETQFDAK

GTPFIAGKRIVPVIENHRFTGRYRDLYPANELIALLEEKGIVFRDGSNIL

PKLLENDDSHAIDTMVALIRSVLQMRNSNAATGEDYINSPVRDLNGVCFD

SRFQNPEWPMDADANGAYHIALKGQLLLNHLKESKDLKLQNGISNQDWLA

YIQELRNGRKRPAATKKAGQAKKKKGGSGGSKRTADGSEFESPKKKRKVE

GGSGGSGGSGGSGGSGGSGGSGGSLEHHHHHH

Example 2

Figure 2:
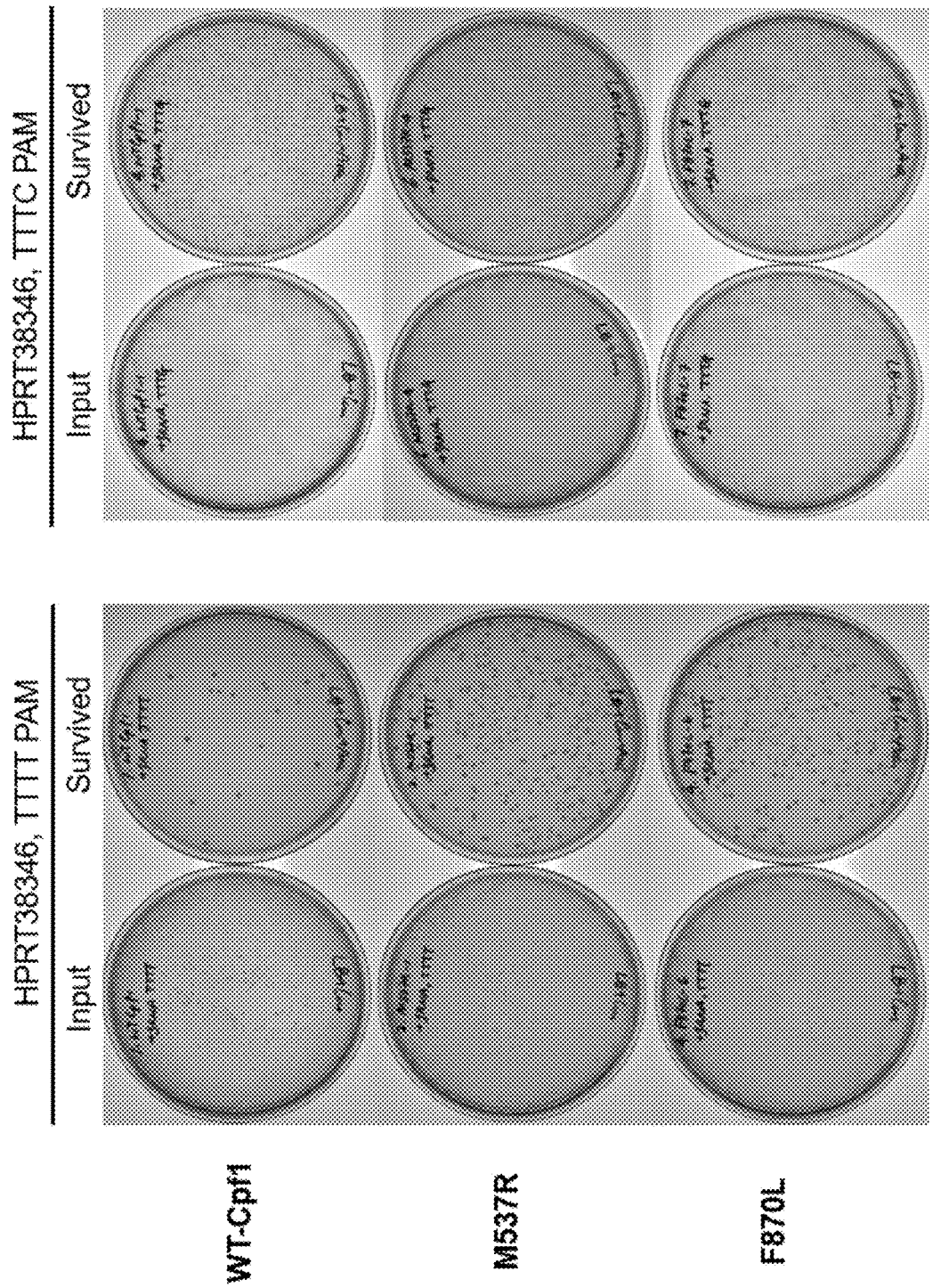
FIG. 2 shows exemplary results of M537R and F870L mutations with enhanced the cleavage activity of Cpf1 in a bacterial-based activity assay. The screening *E. coli* strains were transformed with Cpf1 expression vectors and the crRNA targeting HPRT-38346 site on the toxin expression plasmid. The apparent activity of Cpf1 for TTTT or TTTC PAM can be estimated by the number of survived colonies under arabinose selection when equivalent amount of plasmids is delivered. Clearly, both mutations increased the survival rate at TTTC and TTTT PAM sites, indicating an improved cleavage activity over the WT-Cpf1.

Novel Cpf1 Mutants Enhance the DNA Cleavage Activity at TTTT PAM Site in the Bacterial-Based Activity Assay The following Example demonstrates the enhanced activity of the invention at both TTTT and TTTC PAM sites in a bacterial-based activity assay (FIG. 2). The screening strains harboring the toxin plasmid were transformed with WT, M537R or F870L AsCpf1 expression plasmid. After recovery and IPTG induction, cells were plated on LB-Chloramphenicol media with or without arabinose. The degree of cell survival under the arabinose selection compared to the transformation input control (without arabinose) is indicative of the cleavage activity of Cpf1 variants at the HPRT-38346 protospacer on the toxin plasmid, in the context of TTTT or TTTC PAM.

For WT-Cpf1, the survival rate of transformed E. coli at TTTC is significantly higher than the TTTT PAM, which is in good agreement with the prior knowledge that the TTTT is a low activity PAM site[6]. In contrast, both M537R and F870L increased the survival rate at TTTT PAM, indicating these mutants broadened the PAM compatibility of AsCpf1 at this alternative PAM site. More importantly, the survival rate of both mutants at the canonical TTTC PAM is even higher than the WT-Cpf1, suggesting these mutants generally enhanced the performance of AsCpf1 protein at other TTTV sites as well. Given these positive results, individual AsCpf1 variant and the double mutant (M537R/F870L) were expressed and purified to determine their intrinsic cleavage activities in vitro.

Example 3

Figure 3A:
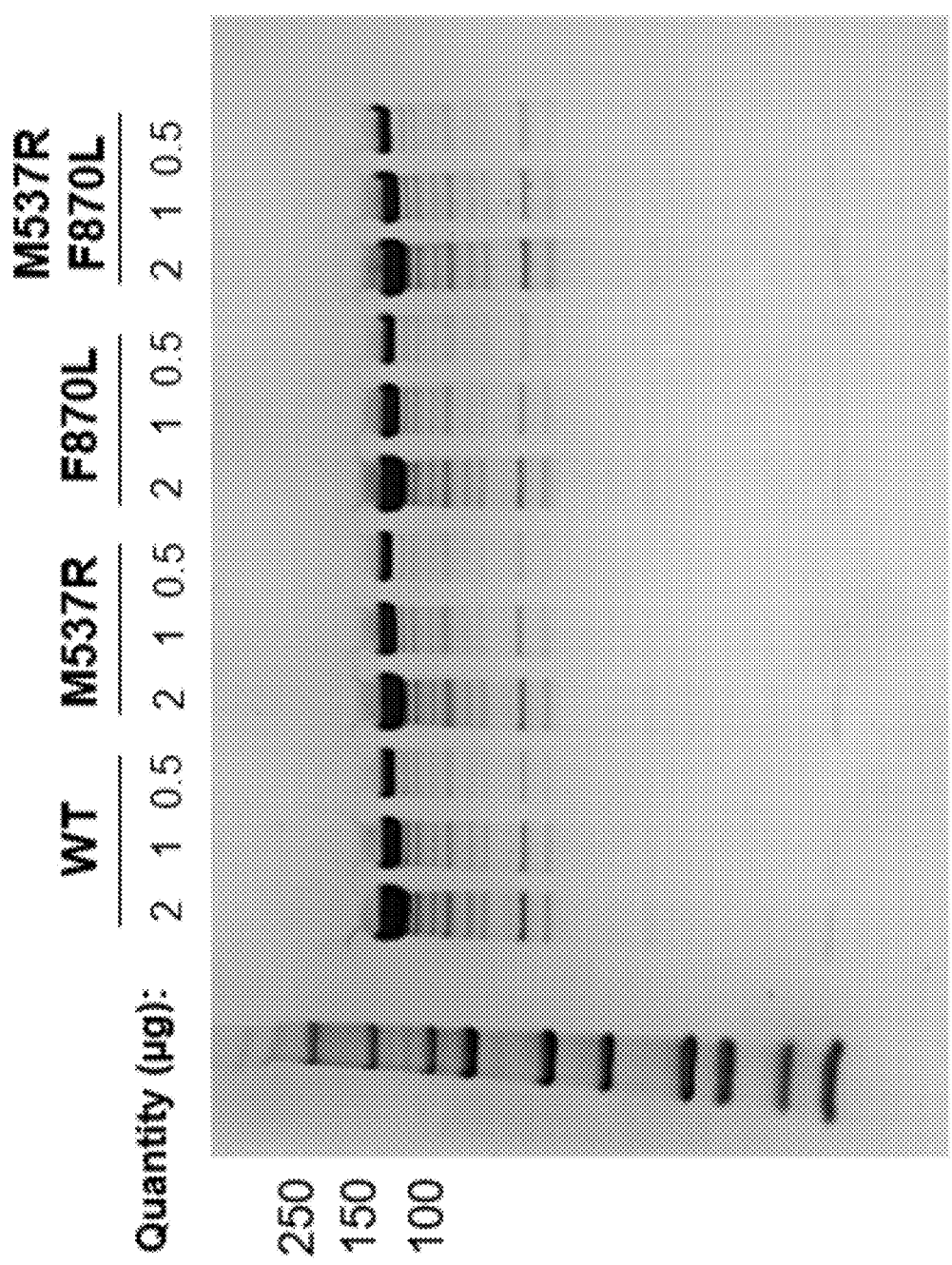
FIG. 3A shows an exemplary SDS-PAGE analysis of AsCpf1 variants used in the in vitro cleavage assay and subsequent genome editing in human cell lines. Indicated quantity of protein was loaded, and no difference was observed comparing to the WT-Cpf1. These results demonstrate M537R and F870L mutations can increase the in vitro cleavage activity of Cpf1 at non-conical TTTT PAM site while maintaining high activity at canonical TTTV site.

Novel Cpf1 Mutants Enhances the Intrinsic DNA Cleavage Activity at TTTT PAM Sites In Vitro The intrinsic DNA cleavage activities of AsCpf1 variants (M537R, F870L and M537R/F870L) were compared to the wild type protein using in vitro cleavage assay. Briefly, the Cpf1-crRNA ribonucleoprotein (RNP) complex was first assembled by incubating the purified proteins (FIG. 3A) with HPRT-38346 crRNA in 1× cleavage buffer (20 mM HEPES, pH 7.5, 150 mM KCl, 5 mM $MgCl_2$, 10% Glycerol, and 1 mM DTT) for 15 minutes at 37° C. The cleavage reactions were initiated by titrating RNP complex (8~500 nM) in 10 nM dsDNA substrate containing the HPRT-38346 protospacer, in the context of TTTC or TTTT PAM. Cleavage reactions at various time points were sampled and quenched by 50 mM EDTA. After removing the AsCpf1 protein by Proteanise K treatment (56° C., 30 minutes), reactions were resolved using capillary electrophoresis (Fragment Analyzer, AATI). The relative concentration of cleavage products and uncleaved dsDNA were quantified to calculate the percentage of DNA cleavage.

Figure 3B:
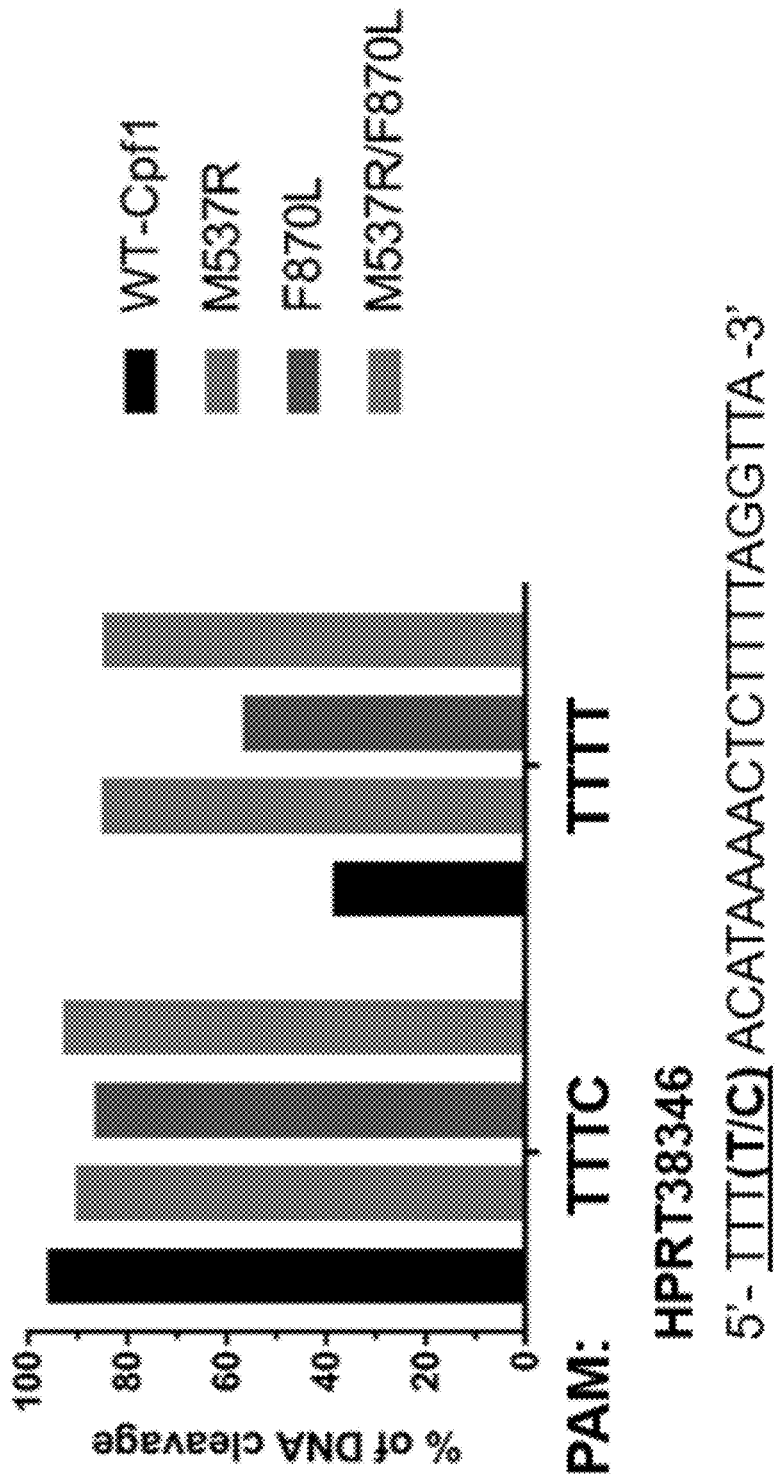
FIG. 3B shows exemplary DNA cleavage activities of Cpf1 variants at HPRT-38346 site with TTTT PAM or TTTC PAM (5'-TTTTACATAAAACTCTTTTAGGTTA-3' (SEQ ID NO.: 494) and 5'-TTTCACATAAAACTCTTT-TAGGTTA-3' (SEQ ID NO.: 495), respectively). Both variants resulted in a higher percentage of DNA cleavage at TTTT PAM site than WT-Cpf1 (TTTC PAM). These results demonstrate M537R and F870L mutations can increase the in vitro cleavage activity of Cpf1 at non-conical TTTT PAM site while maintaining high activity at canonical TTTC site.

The intrinsic DNA cleavage activities of WT and Cpf1 variants at the TTTT and TTTC PAM sites (5'-TTTTACAT-AAAACTCTTTTAGGTTA-3' (SEQ ID NO.: 494) and 5'-TTTCACATAAAACTCTTTTAGGTTA-3' (SEQ ID NO.: 495), respectively) were compared in FIG. 3B. Only a single RNP concentration (31 nM) at 20 seconds time-point was shown for simplicity. As expected, the single-nucleotide change of PAM sequence from TTTC to TTTT reduced the cleavage activity of WT-Cpf1 from ~95% to ~40%. Consistent with the observations in the bacterial-based activity assay, both mutants significantly increased the DNA cleavage at TTTT PAM, while maintaining high activity at TTTC PAM (FIG. 3B). The double-mutant (M537R/F870L) has similar activities to the M537R in this assay. However, it is worth to note that this is likely due to the limited resolution of this particular assay, to resolve further differences among those high-activity variants. Overall, these results demonstrated that the reported mutations improved the activity of Cpf1 by enhancing the intrinsic DNA cleavage. Therefore, we anticipate that the observed benefits of these mutants will be broadly applicable and independent of the delivery methods and/or cellular contexts of the specific experiment.

Example 4

Novel Mutants Broadly Enhance the Targeting Efficiency of TTTN PAM Sites in Human Cell Line The following Example demonstrates the ability of the invention to increase the efficiency of gene editing at TTTN PAM sites when the Cpf1-crRNA complex is delivered into cells as an RNP.

CRISPR/Cpf1 cellular editing experiments were performed by first forming 4 mM RNP complex with purified Cpf1 protein and the Alt-R™ crRNAs in Opti-MEM for 5 min at 25° C. The targeted protospacers and PAM sequences in CTNNB1 loci are shown in Table 2. RNP complexes were then transfected into HEK293 cells by Lonza nucleofection. Experiments were performed in biological triplicate. After 48 hr at 37° C. with 5% $CO_2$, adherent cells were washed with 0.1 ml PBS and lysed with 0.05 ml QuickExtract' DNA extraction solution. Cell lysates were incubated at 65° C. for 15 min followed by heat-inactivation at 98° C. for 3 min. Crude DNA samples were then diluted 3-fold with 0.1 ml dd$H_2$O and used as PCR templates. PCR primers are indicated in Table 2. PCR was used to amplify 1 kb fragments of the CTNNB1 loci using the KAPA HiFi DNA Polymerase and the following cycling parameters: $95^{5:00}$ ($98^{0:20}$, $64^{0:15}$, $72^{0:30}$) repeated 29 times, $72^{2:00}$.

Heteroduplexes were formed using the following cycling parameters: $95^{10:00}$ cooled to 85 over 1 min, $85^{1:00}$ cooled to 75 over 1 min, $75^{1:00}$ cooled to 65 over 1 min, $65^{1:00}$ cooled to 55 over 1 min, $55^{1:00}$ cooled to 45 over 1 min, $45^{1:00}$ cooled to 35 over 1 min, $35^{1:00}$ cooled to 25 over 1 min, $25^{1:00}$. Heteroduplexes were cleaved by the addition of 2U T7 Endonuclease I (New England Biolabs) for 1 hr at 37 C, and cut products were analyzed by capillary electrophoresis (Fragment Analyzer, Advanced Analytical).

TABLE 2

Sequence of DNA target sites and primer used for PCR amplification (SEQ ID NOs.: 31-58).

| Name | Sequence (5'-3') | SEQ ID NO.: |
|---|---|---|
| HPRT38346 TTTT PAM | TTTTACATAAAACTCTTTTAGGTTA | SEQ ID NO.: 31 |
| HPRT38346 TTTC PAM | TTTCACATAAAACTCTTTTAGGTTA | SEQ ID NO.: 32 |
| CTNNB1 111-S | TTTTCCCCTCCCTGGCTTTTATTAT | SEQ ID NO.: 33 |
| CTNNB1 112-S | TTTTCCCCTCCCTGGCTTTTATTATT | SEQ ID NO.: 34 |
| CTNNB1 127-S | TTTTATTATTACAACTCTGTGCTTT | SEQ ID NO.: 35 |
| CTNNB1 128-S | TTTATTATTACAACTCTGTGCTTTT | SEQ ID NO.: 36 |
| CTNNB1 149-S | TTTTTCATCACCATCCTGAATATCT | SEQ ID NO.: 37 |
| CTNNB1 150-S | TTTTCATCACCATCCTGAATATCTA | SEQ ID NO.: 38 |
| CTNNB1 151-S | TTTCATCACCATCCTGAATATCTAT | SEQ ID NO.: 39 |
| CTNNB1 184-S | TTTATACTATTAATAAAAAGACATT | SEQ ID NO.: 40 |
| CTNNB1 193-AS | TTTATTAATAGTATAAATATTAATT | SEQ ID NO.: 41 |
| CTNNB1 194-AS | TTTTATTAATAGTATAAATATTAAT | SEQ ID NO.: 42 |
| CTNNB1 195-AS | TTTTTATTAATAGTATAAATATTAA | SEQ ID NO.: 43 |
| CTNNB1 207-S | TTTTTGGTAAGGAGGAGTTTTCACT | SEQ ID NO.: 44 |
| CTNNB1 208-S | TTTTGGTAAGGAGGAGTTTTCACTG | SEQ ID NO.: 45 |
| CTNNB1 209-S | TTTGGTAAGGAGGAGTTTTCACTGA | SEQ ID NO.: 46 |
| CTNNB1 224-S | TTTTCACTGAAGTTCAGCAGTGATG | SEQ ID NO.: 47 |
| CTNNB1 225-S | TTTCACTGAAGTTCAGCAGTGATGG | SEQ ID NO.: 48 |
| CTNNB1 291-S | TTTCACTAACCTGGTAAAGAGGAT | SEQ ID NO.: 49 |
| CTNNB1 301-AS | TTTACCAGGTTAGTGAAACGCAGAC | SEQ ID NO.: 50 |
| CTNNB1 302-AS | TTTTACCAGGTTAGTGAAACGCAGA | SEQ ID NO.: 51 |
| CTNNB1 321-S | TTTTTTTGTGGGTGTAATAGTGAC | SEQ ID NO.: 52 |
| CTNNB1 322-S | TTTTTTTGTGGGTGTAATAGTGACA | SEQ ID NO.: 53 |
| CTNNB1 323-S | TTTTTTGTGGGTGTAATAGTGACAT | SEQ ID NO.: 54 |
| CTNNB1 324-S | TTTTTGTGGGTGTAATAGTGACATT | SEQ ID NO.: 55 |
| CTNNB1 325-S | TTTTGTGGGTGTAATAGTGACATTT | SEQ ID NO.: 56 |
| CTNNB1_FWD | TCCCACTGTACCTCTGTTATCCA | SEQ ID NO.: 57 |
| CTNNB1_REV | TGGTCCTCGTCATTTAGCAGTTT | SEQ ID NO.: 58 |

Figure 4:
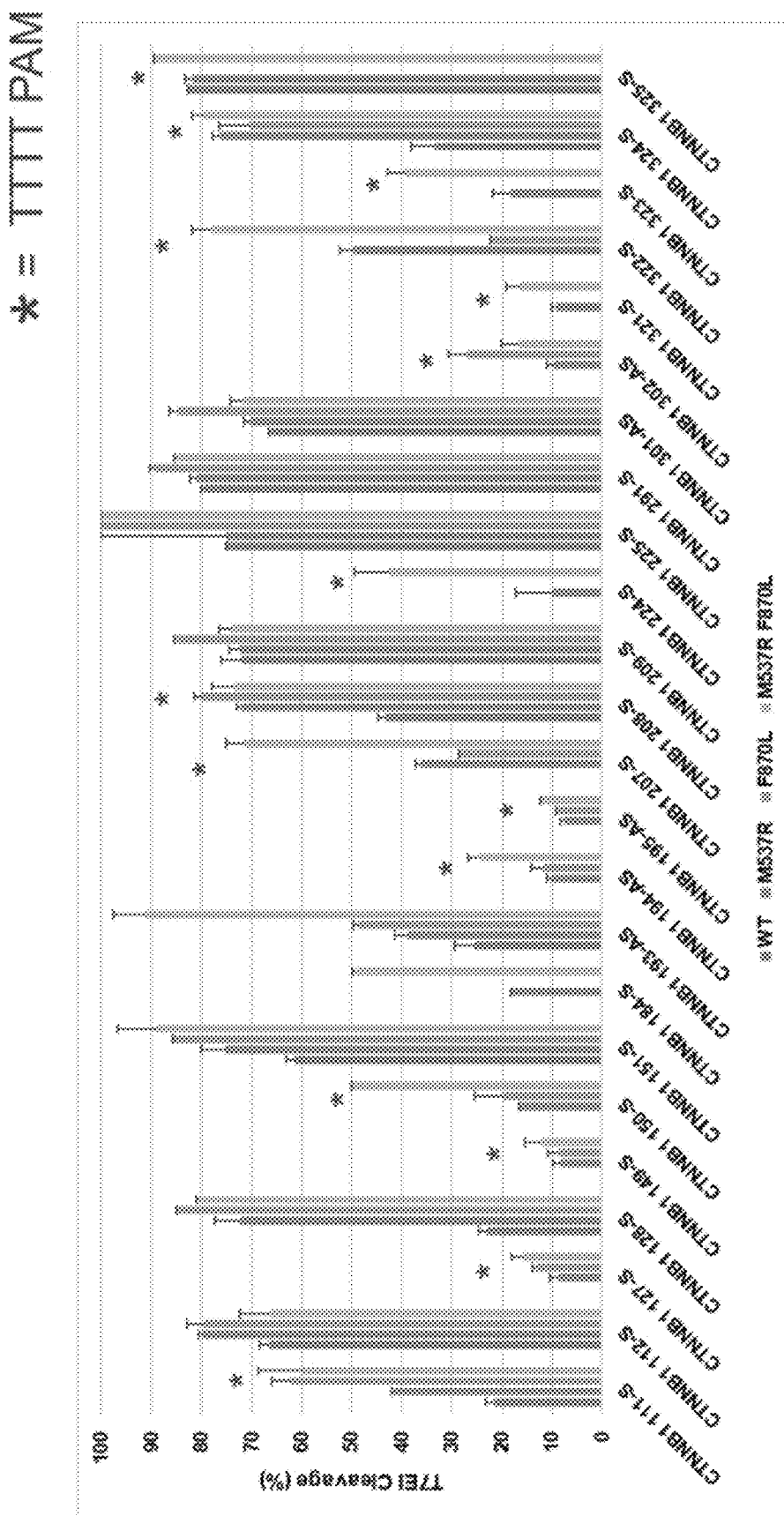
FIG. 4 shows a summary of results showing exemplary results of M537R and F870L mutations having broadly enhanced the genomic targeting efficiency of AsCpf1 at TTTN PAM sites in human cell line. The genomic targeting efficiencies of Cpf1 variants were tested in a human cell line model using T7 endonuclease I assay (T7EI). Twenty-four crRNAs targeting the CTNNB1 gene with TTTN PAMs were synthesized, assembled with Cpf1 variants as RNP complex, and delivered by nucleofection (Lonza). The genomic DNA was collected 48 hours post-delivery to assess the formation of indels by T7EI. Not only enabled DNA cleavage at all TTTT PAM sites that many were not targetable by WT-Cpf1, the reported variants, particularly the double-mutant (M537R/F870L), broadly enhanced the targeting efficiency of Cpf1 at 22 of 24 tested sites regardless of PAM sequence.
Figure 5A:
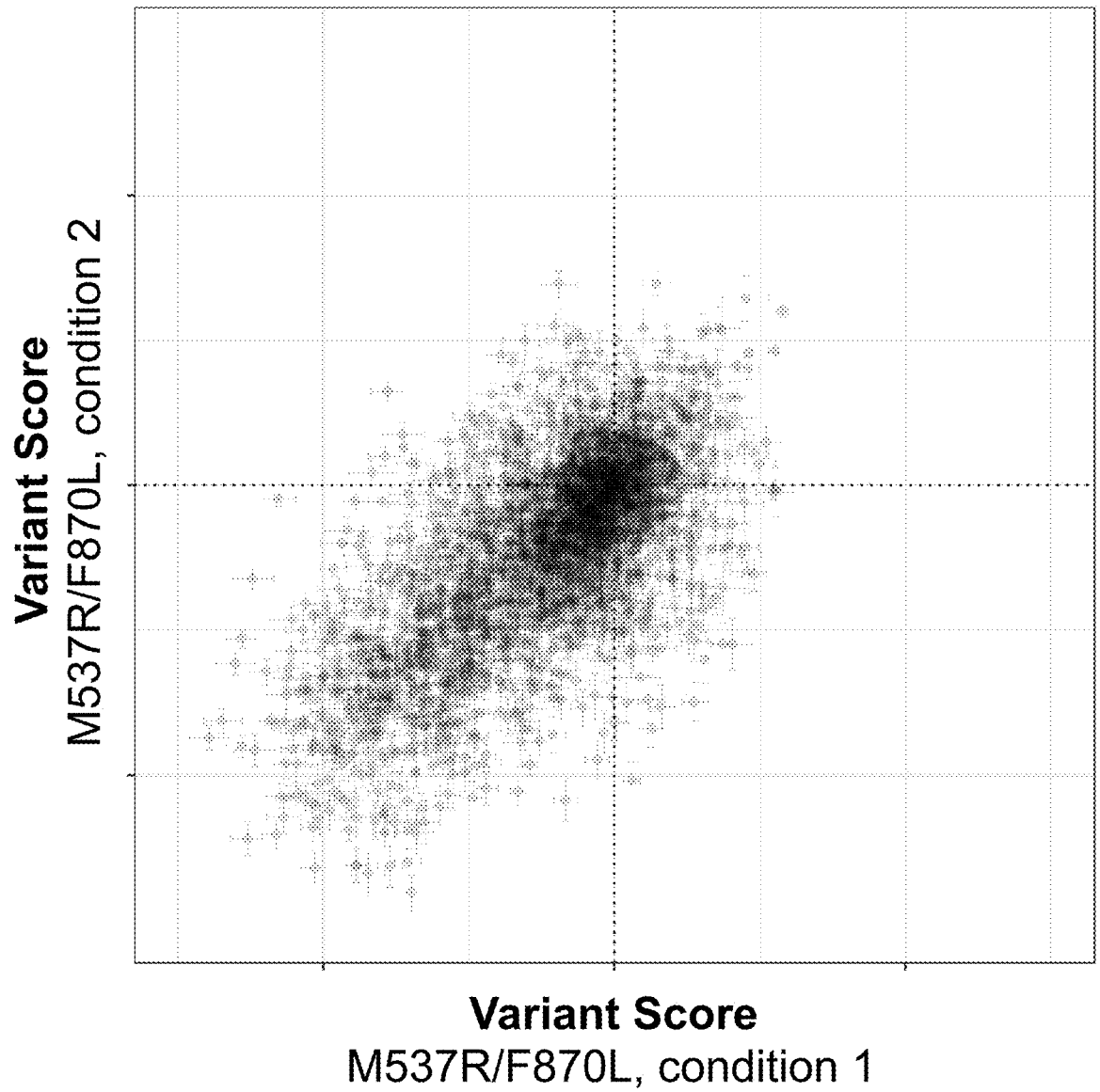
FIG. 5A shows exemplary correlation of relative survival rate of M537R/F870L-AsCas12a under condition 1 (X-axis) vs. relative survival rate of M537R/F870L-AsCas12a condition 2 (Y-axis). Consistent phenotype measurement was obtained ($\rho$~0.7).
Figure 5B:
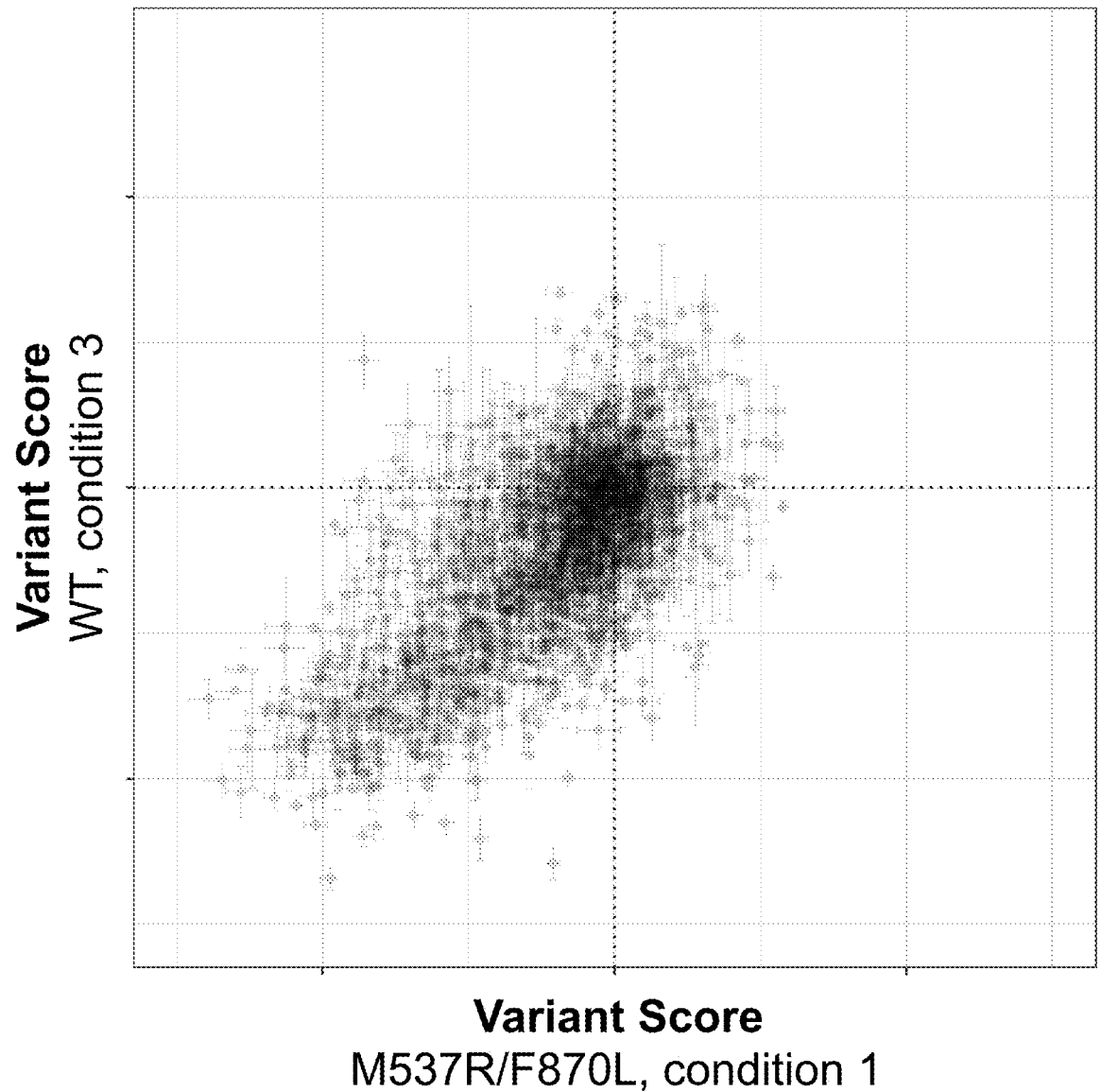
FIG. 5B shows exemplary correlation of relative survival rate of M537R/F870L-AsCas12a under condition 1 (X-axis) vs. relative survival rate of WT-AsCas12a under condition 3 (Y-axis). Consistent phenotype measurement was obtained ($\rho$~0.7).
Figure 5C:
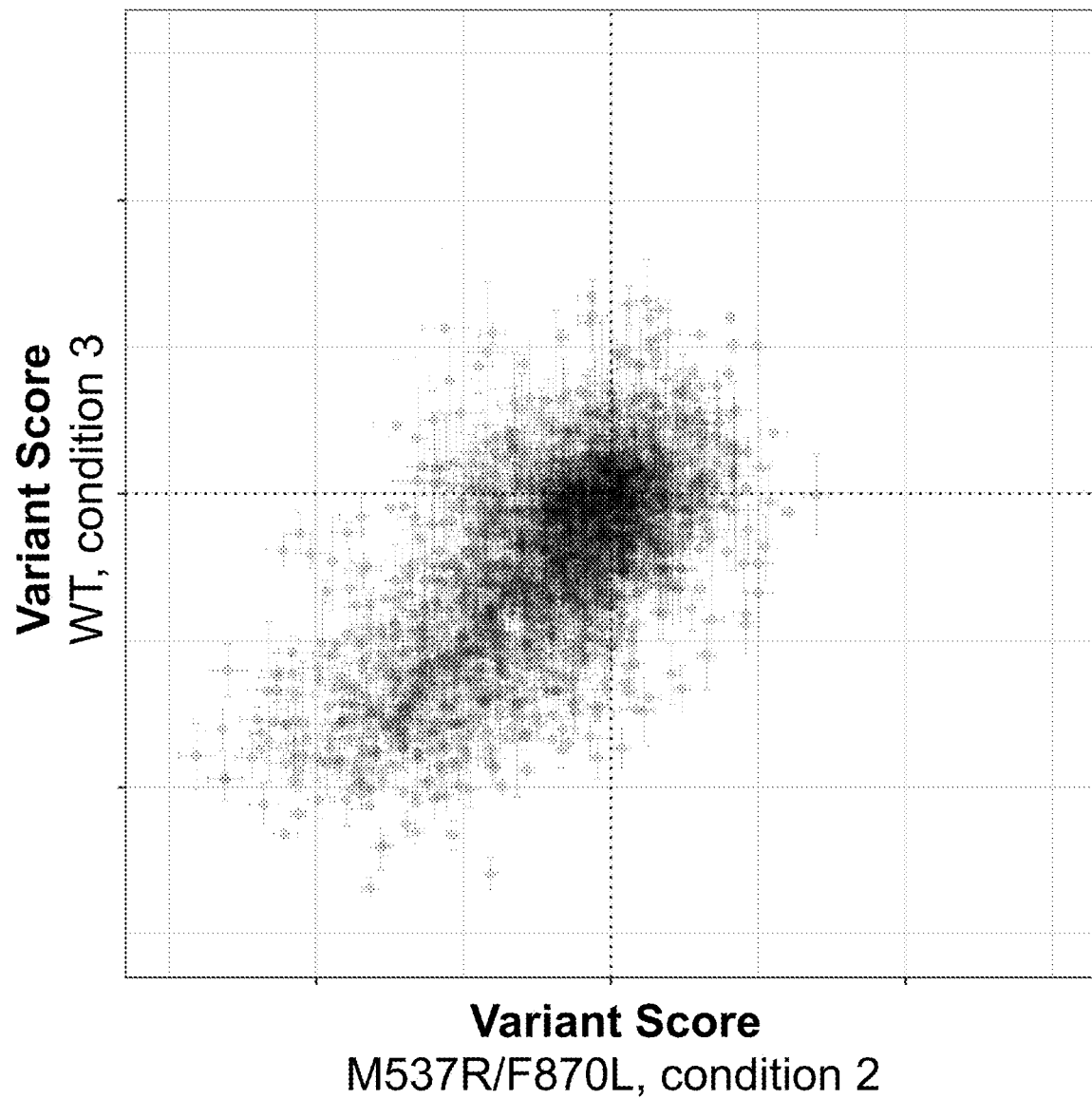
FIG. 5C shows exemplary correlation of relative survival rate of M537R/F870L-AsCas12a under condition 2 (X-axis) vs. relative survival rate of WT-AsCas12a under condition 2 (Y-axis). Consistent phenotype measurement was obtained ($\rho$~0.7).
Figure 5D:
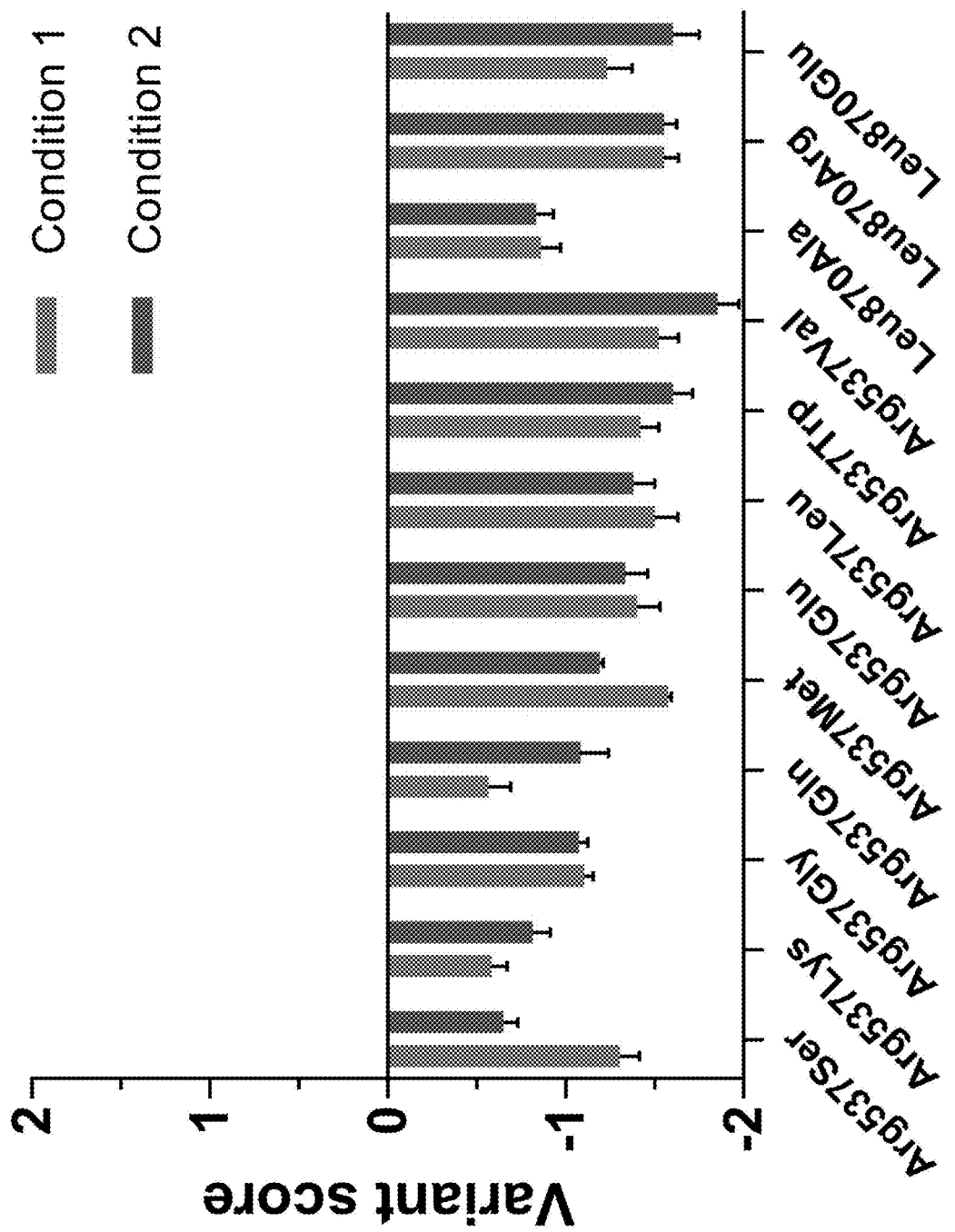
FIG. 5D shows exemplary variant scores of phenotype (relative survival rate) of single point mutations of a selected number of AsCas12a at positions 537 and 870 under conditions 1 and 2.
Figure 5E:
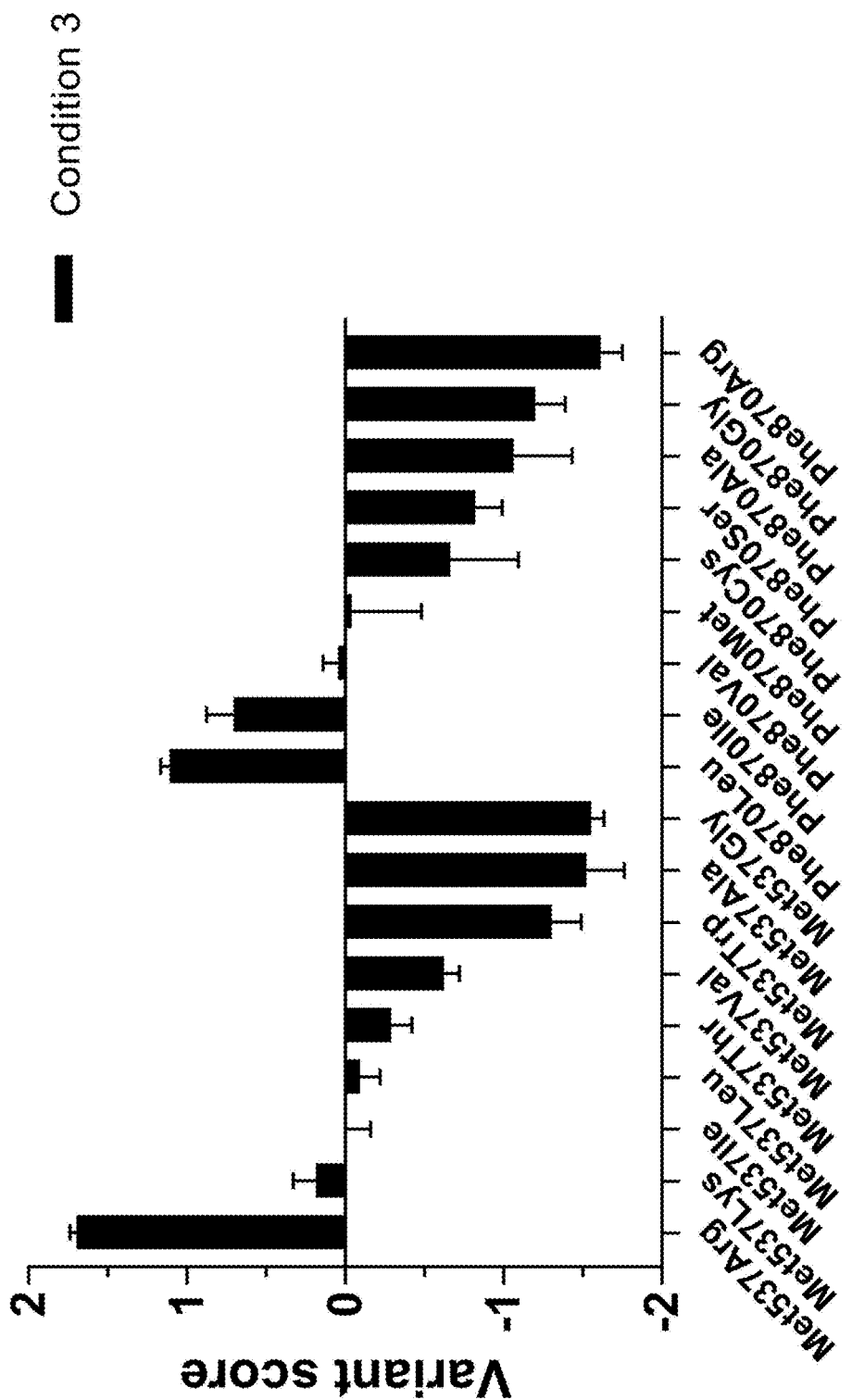
FIG. 5E shows exemplary variant scores of phenotype (relative survival rate) of single point mutations of a selected number of AsCas12a at positions 537 and 870 under conditions 1 and 2.
Figure 5F:
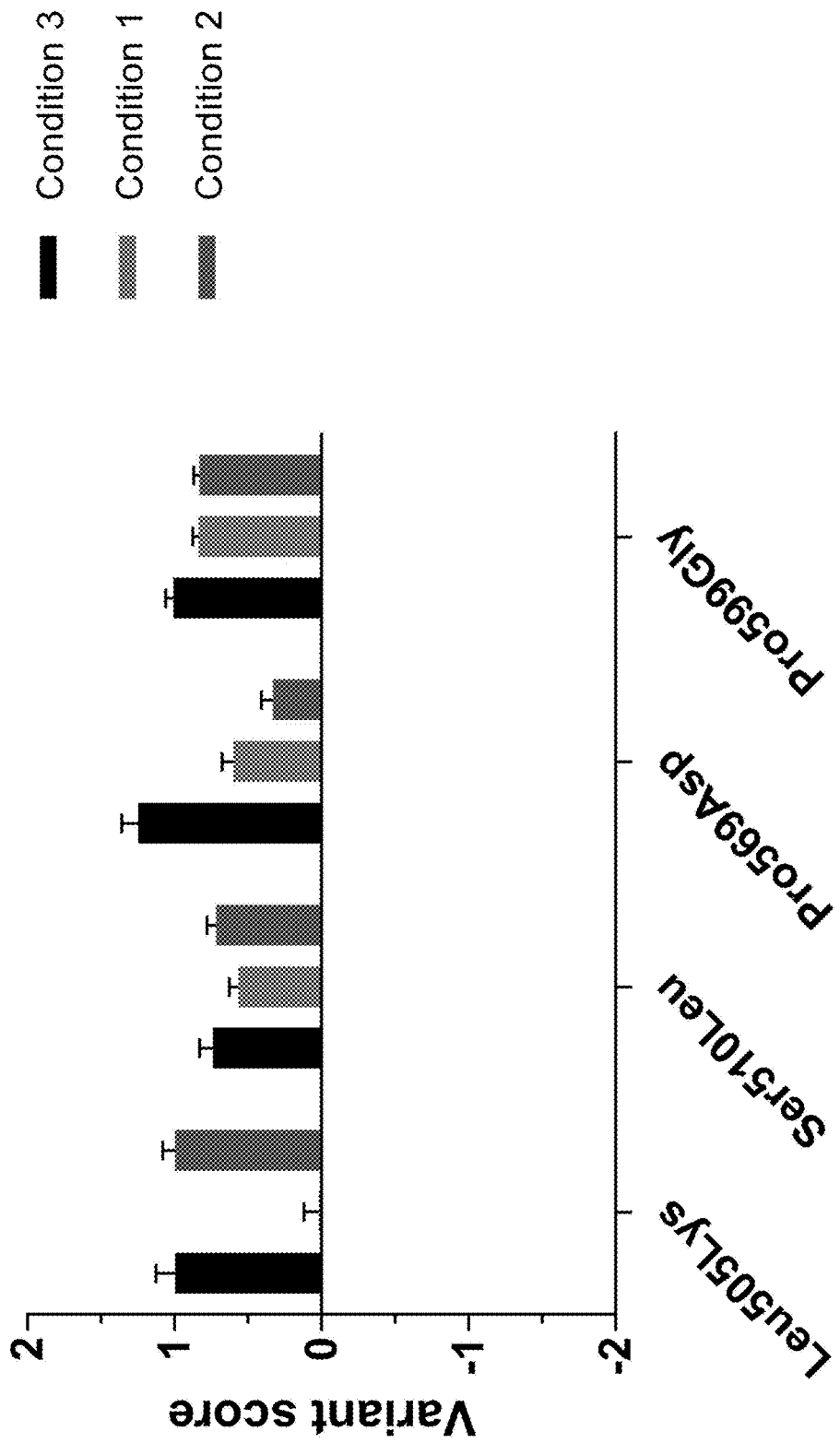
FIG. 5F shows exemplary variant scores of phenotype (relative survival rate) of single point mutations of a selected number of AsCas12a at positions 505, 510, 569 and 599 under conditions 1, 2 and 3.
Figure 6A:
FIG. 6A shows survival rate of E. coli resulting from DNA cleavage activity of WT-AsCas12a at TTTT PAM. The cleavage activity of AsCas12a variants at TTTT PAM site was measured by bacterial-based activity assay. The petri dish plated with the initial bacterial plating is shown on the left, while the petri dish having the surviving bacterial colonies is shown on the right. The survival of E. coli under selection is dependent on the success cleavage of a toxin-expressing plasmid containing a TTTT PAM site.
Figure 6A:
Figure 6B:
FIG. 6B shows survival rate of E. coli resulting from DNA cleavage activity of L505K-AsCas12a variant at TTTT PAM. The presentation of petri dishes and experimental details are as set forth in FIG. 6A.
Figure 6C:
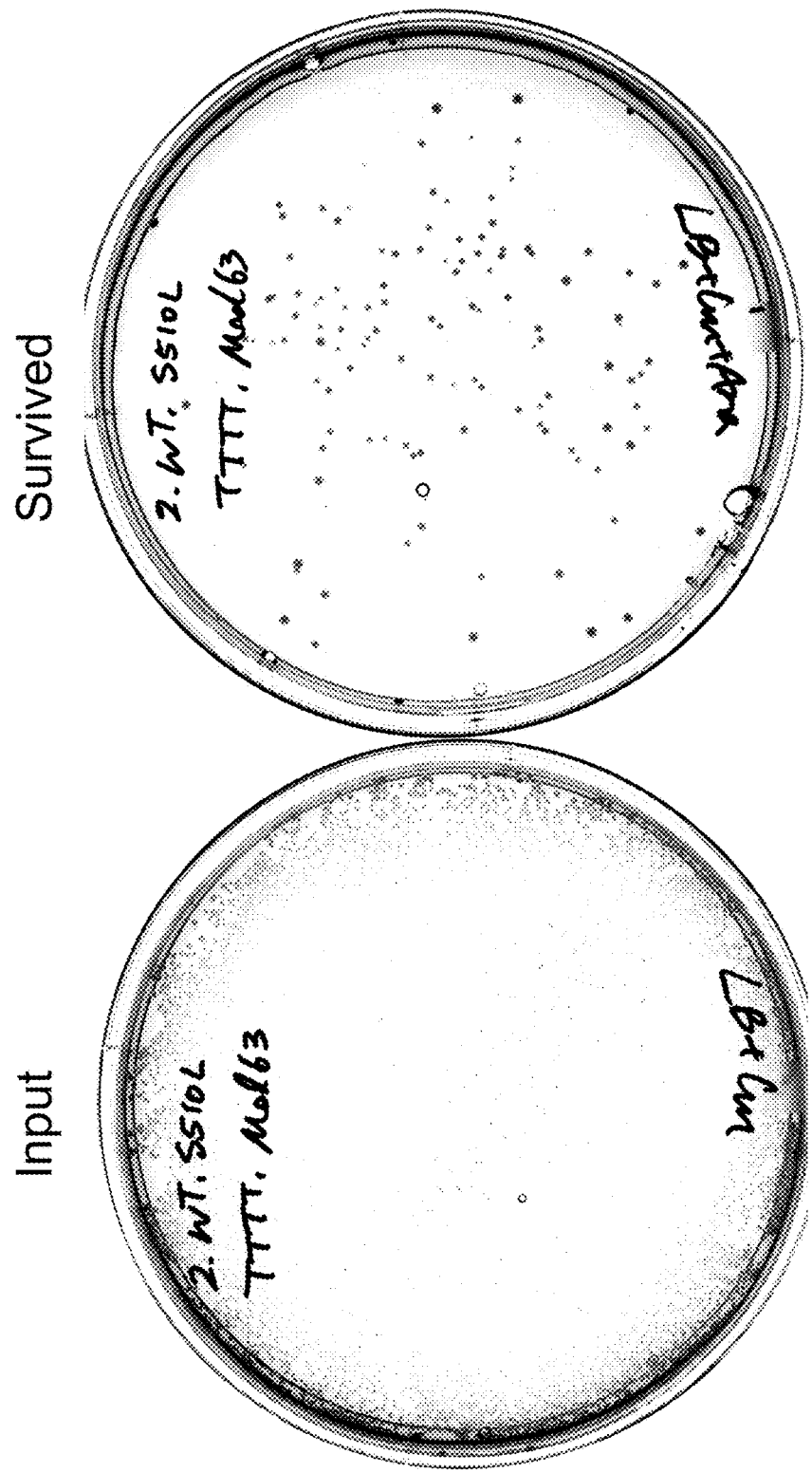
FIG. 6C shows survival rate of E. coli resulting from DNA cleavage activity of S510L-AsCas12a variant at TTTT PAM. The presentation of petri dishes and experimental details are as set forth in FIG. 6A.
Figure 6D:
FIG. 6D shows survival rate of E. coli resulting from DNA cleavage activity of M537R-AsCas12a variant at TTTT PAM. The presentation of petri dishes and experimental details are as set forth in FIG. 6A.
Figure 6E:
FIG. 6E shows survival rate of E. coli resulting from DNA cleavage activity of P569D-AsCas12a variant at TTTT PAM. The presentation of petri dishes and experimental details are as set forth in FIG. 6A.
Figure 6E:
Figure 6F:
FIG. 6F shows survival rate of E. coli resulting from DNA cleavage activity of P599G-AsCas12a variant at TTTT PAM. The presentation of petri dishes and experimental details are as set forth in FIG. 6A.
Figure 6F:
Figure 7A:
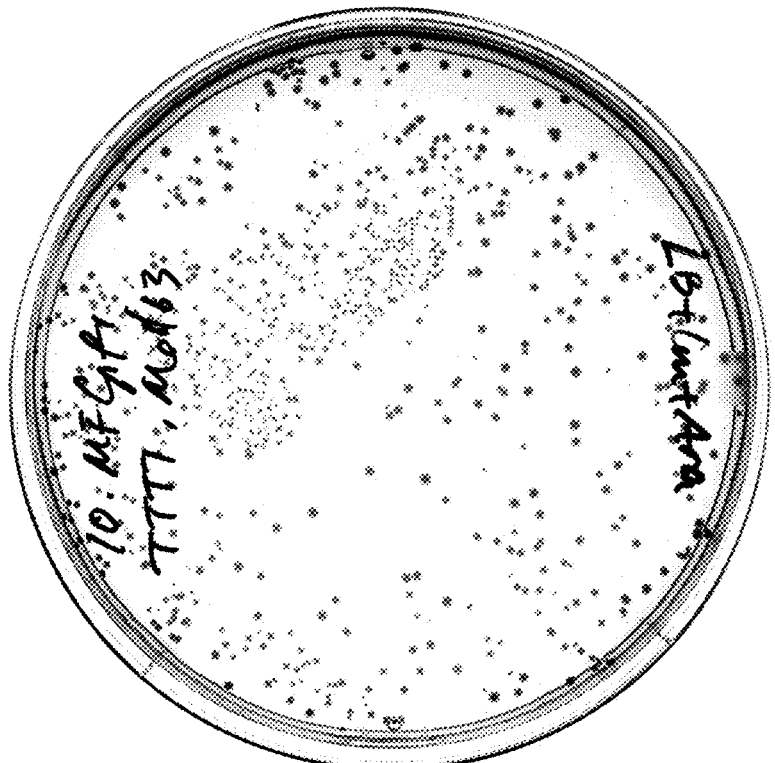
FIG. 7A shows survival rate of E. coli resulting from DNA cleavage activity of M537R/F870L-AsCas12a at TTTT PAM. The cleavage activity of M537R/F870L-AsCas12a variants at TTTT PAM site was measured by bacterial-based activity assay. The petri dish plated with the initial bacterial plating is shown on the left, while the petri dish having the surviving bacterial colonies is shown on the right. The survival of E. coli under selection is dependent on the success cleavage of a toxin-expressing plasmid containing a TTTT PAM site.
Figure 7A:
Figure 7B:
FIG. 7B shows survival rate of E. coli resulting from DNA cleavage activity of L505K/M537R/F870L-AsCas12a variant at TTTT PAM. The presentation of petri dishes and experimental details are as set forth in FIG. 7A.
Figure 7B:
Figure 7C:
FIG. 7C shows survival rate of E. coli resulting from DNA cleavage activity of M537R/F870L-AsCas12a variant at TTTT PAM. The presentation of petri dishes and experimental details are as set forth in FIG. 7A.
Figure 7C:
Figure 7D:
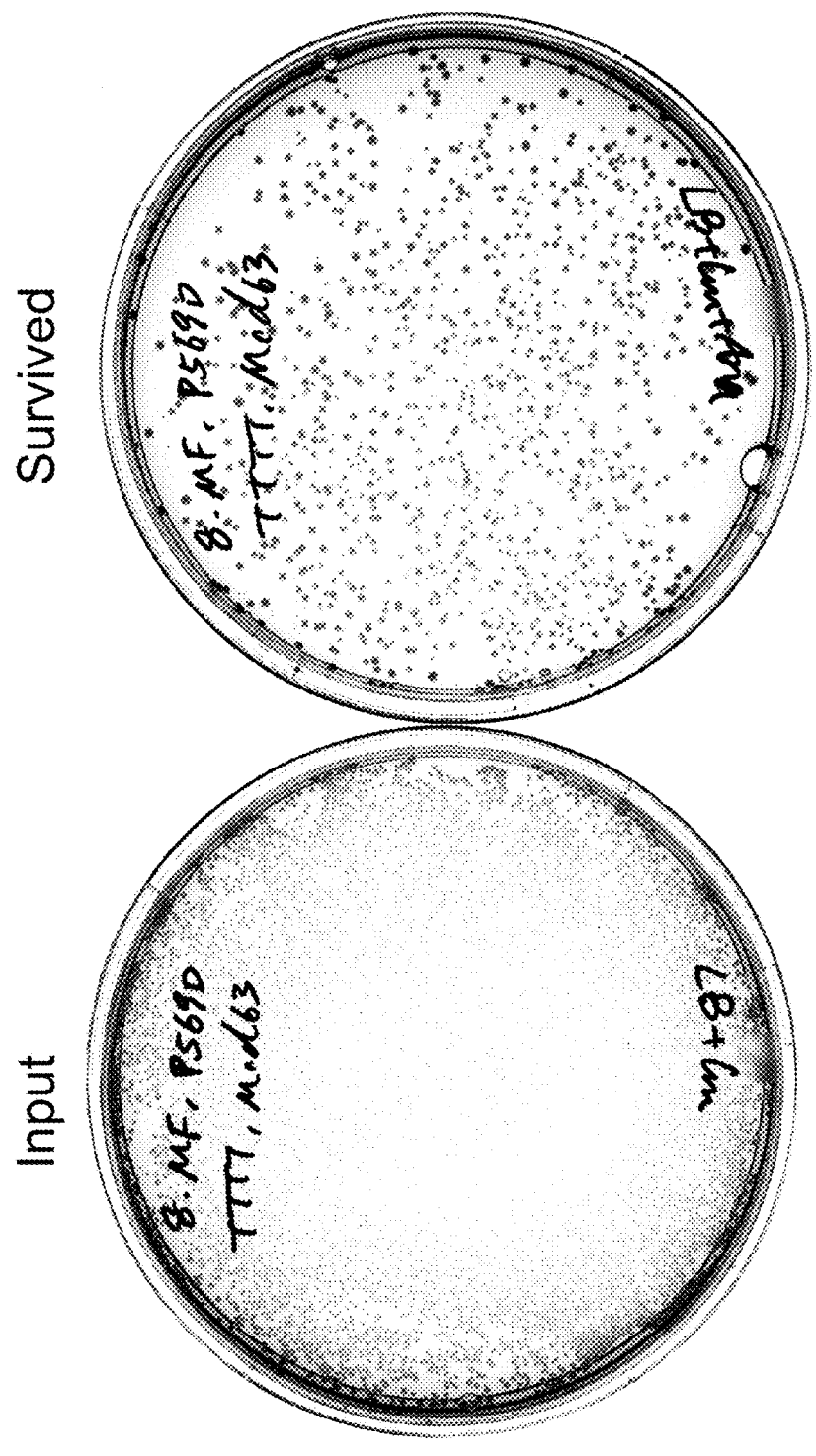
FIG. 7D shows survival rate of E. coli resulting from DNA cleavage activity of P569D/M537R/F870L-AsCas12a variant at TTTT PAM. The presentation of petri dishes and experimental details are as set forth in FIG. 7A.
Figure 7E:
FIG. 7E shows survival rate of E. coli resulting from DNA cleavage activity of P599G/M537R/F870L-AsCas12a variant at TTTT PAM. The presentation of petri dishes and experimental details are as set forth in FIG. 7A.
Figure 7E:
Figure 7F:
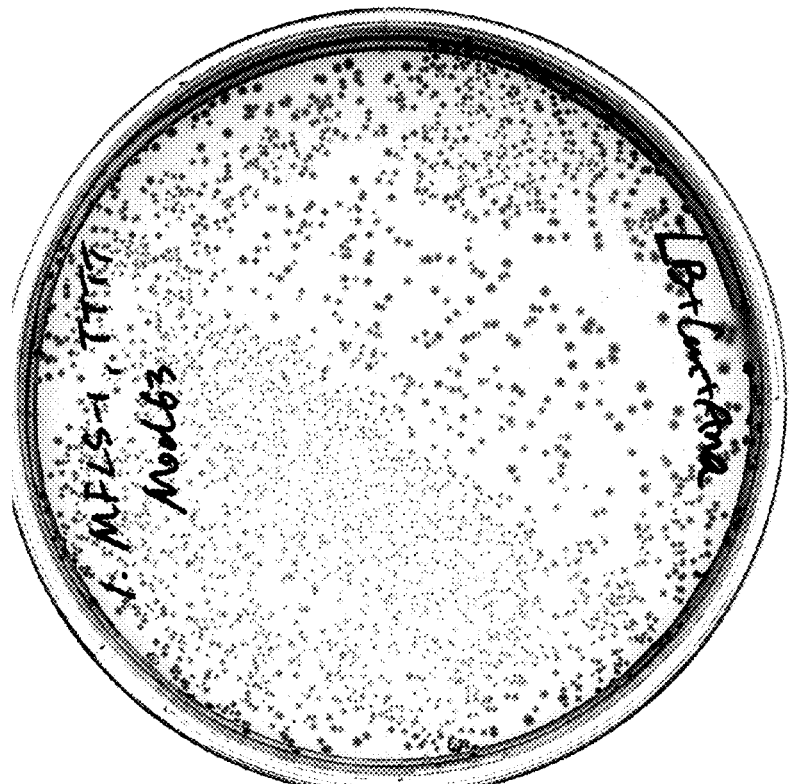
FIG. 7F shows survival rate of E. coli resulting from DNA cleavage activity of S510L/M537R/F870L-AsCas12a variant at TTTT PAM. The presentation of petri dishes and experimental details are as set forth in FIG. 7A.
Figure 7F:

Referring to FIG. 4, T7EI assay revealed significant improvement of the targeting efficiency by M537R and F870L mutations. First, M537R, F870L or the double-mutant (M537R/F870L) enabled efficient cleavage at all 15 sites with TTTT PAM, where 11 of 15 have no detectable cleavage by WT-Cpf1. For other sites with canonical TTTV PAM, these variants maintained or improved the targeting efficiency. The benefit is particularly significant at those low-activity sites, such as CTNNB1 111-s (3-fold improvement over WT). Among these variants, the double-mutant (M537R/F870) has the most consistent improvement of targeting efficiency across all tested sites, where the singly mutants exhibited more site-dependent variations, such as F870L at 323-S (no activity, same as WT). Overall, the described invention exhibits vastly superior on-target potency than the WT-Cpf1.

Example 5

High-Throughput Measurement of the DNA Cleavage Activity of AsCas12a Variants at TTTT PAM Site in E. coli The following Example demonstrates the robustness of our novel high-throughput screening strategy to directly measure the cleavage activity of thousands AsCas12a variants at TTTT PAM site in the bacterial-based activity assay (FIG. 5). FIG. 5A-F shows exemplary high-throughput phenotype measurement of AsCas12a point mutations by deep-scanning mutagenesis. A library encompassing every possible single point mutation of AsCas12a in the targeted region (499-640 and 840-913) was generated in the context of WT-AsCas12a or M537R/F870L-AsCas12a. The relative survival rate of each variant over the reference protein in an E. coil-based activity assay was determined by deep-sequencing. The phenotype of individual point mutations was measured under multiple selection stringencies in the context of M537R/F870L (condition 1 and 2), and a third condition in the WT-AsCas12a background (condition 3). As shown in FIG. 5A-C, the phenotype scores (i.e. natural logarithm of relative survival rate) of variants are positively correlated under different conditions (ρ~0.7), demonstrating the consistency and reproducibility of this approach. As the positive control, only the M537R and F870L/I, but not any other substitutions at these positions, survived more than the WT-AsCas12a (FIG. 5D). Conversely, mutating R537 or L870 on the M537R/F870L-AsCas12a ubiquitously reduced the survival rate (FIG. 5E). These results demonstrated that the phenotype score measured by the bacterial screening reflects the DNA cleavage activity of previously characterized AsCas12a variants at TTTT PAM.

To further validate the result of our bacterial screen, we studied four point mutations of AsCas12a with greater survival rate than the reference under all three conditions (L505K, S510L, P569D and P599G, FIG. 5F), Of note, P599G has been shown to enhance the cleavage activity of AsCas12a at TTCC PAM. The other three point mutations have not been characterized by any published studies so far. We therefore measured the survival rate of E. coli cells transformed with plasmids expressing individual AsCas12a variant under selection. Compared to WT-AsCas12a, all selected point mutations increased the survival rate when targeting a TTTT-PAM site (FIG. 6). Unexpectedly, the benefits of these point mutations held true even in the context of M537R/F870L-AsCas12a, where the survival rate was further elevated (FIG. 7). Collectively, these results demonstrated that our high-throughput screening can accurately predict the phenotype of uncharacterized AsCas12a variants.

The phenotype scores of 3,194 AsCas12a variants with single point mutation covered by the screening with sufficient sequencing count are listed in Table 3. Overall, ~60% exhibited some benefits (i.e. phenotype score>0) in one of the three condition.

TABLE 3

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| R499C | 0.14 | 0.08 | 0.60 | 0.07 | 0.06 | 0.10 | Yes | Yes |
| R499L | 0.08 | 0.05 | 0.05 | 0.06 | 0.09 | 0.15 | Yes | Yes |
| R499K | 0.54 | 0.06 | 0.23 | 0.06 | 0.38 | 0.10 | Yes | Yes |
| R499A | −0.29 | 0.05 | 0.27 | 0.04 | 0.22 | 0.07 | Yes | No |
| R499N | 0.39 | 0.11 | −0.49 | 0.15 | −0.13 | 0.29 | Yes | No |
| R499D | 0.03 | 0.09 | −1.01 | 0.12 | −0.51 | 0.44 | Yes | No |
| R499Q | −0.10 | 0.08 | 0.42 | 0.07 | 0.19 | 0.20 | Yes | No |
| R499E | −0.23 | 0.06 | 0.50 | 0.05 | −0.10 | 0.10 | Yes | No |
| R499G | −0.11 | 0.03 | 0.12 | 0.03 | 0.14 | 0.06 | Yes | No |
| R499H | −0.45 | 0.11 | 0.50 | 0.09 | NA | NA | Yes | No |
| R499I | −0.14 | 0.10 | 0.09 | 0.09 | −0.18 | 0.13 | Yes | No |
| R499M | −0.44 | 0.09 | 0.50 | 0.07 | 0.27 | 0.21 | Yes | No |
| R499F | 0.01 | 0.15 | −0.31 | 0.17 | NA | NA | Yes | No |
| R499P | −0.56 | 0.08 | −0.06 | 0.07 | −0.70 | 0.26 | No | No |
| R499S | −0.14 | 0.05 | 0.02 | 0.05 | −0.04 | 0.06 | Yes | No |
| R499* | −0.76 | 0.10 | −0.61 | 0.10 | −1.06 | 0.18 | No | No |
| R499T | −0.01 | 0.07 | 0.56 | 0.06 | 0.23 | 0.16 | Yes | No |
| R499W | −0.27 | 0.05 | 0.11 | 0.05 | −0.53 | 0.11 | Yes | No |
| R499V | 0.09 | 0.05 | 0.09 | 0.05 | −0.10 | 0.14 | Yes | No |
| L500M | 0.01 | 0.05 | 0.30 | 0.05 | 0.28 | 0.12 | Yes | Yes |
| L500A | −0.27 | 0.04 | 0.21 | 0.03 | −0.15 | 0.07 | Yes | No |
| L500R | −0.35 | 0.03 | −0.40 | 0.03 | −0.47 | 0.05 | No | No |
| L500N | −1.11 | 0.14 | −0.60 | 0.12 | −0.50 | 0.16 | No | No |
| L500D | −1.03 | 0.08 | −1.98 | 0.13 | −1.26 | 0.19 | No | No |
| L500C | −0.19 | 0.05 | 0.26 | 0.05 | 0.00 | 0.10 | Yes | No |
| L500Q | −0.67 | 0.06 | −0.63 | 0.06 | −0.13 | 0.07 | No | No |
| L500E | −1.00 | 0.06 | −1.22 | 0.07 | −1.29 | 0.07 | No | No |
| L500G | −0.72 | 0.03 | −0.79 | 0.03 | −0.84 | 0.03 | No | No |
| L500H | −0.30 | 0.09 | 0.01 | 0.08 | 0.01 | 0.22 | Yes | No |
| L500I | −0.31 | 0.09 | 0.07 | 0.08 | 0.26 | 0.15 | Yes | No |
| L500K | −1.21 | 0.09 | −0.32 | 0.07 | −0.28 | 0.07 | No | No |
| L500F | −0.19 | 0.08 | −0.33 | 0.09 | 0.09 | 0.21 | Yes | No |
| L500P | −0.79 | 0.05 | −0.80 | 0.05 | −0.91 | 0.07 | No | No |
| L500S | −0.84 | 0.04 | −0.43 | 0.04 | −0.37 | 0.07 | No | No |
| L500* | −1.39 | 0.09 | −1.60 | 0.11 | −1.66 | 0.16 | No | No |
| L500T | −0.19 | 0.05 | −0.37 | 0.06 | −0.17 | 0.06 | No | No |
| L500W | −0.25 | 0.04 | −0.29 | 0.04 | 0.01 | 0.11 | Yes | No |
| L500Y | −0.01 | 0.09 | 0.04 | 0.09 | 0.05 | 0.22 | Yes | No |
| L500V | −0.13 | 0.03 | 0.11 | 0.03 | −0.03 | 0.06 | Yes | No |
| T501L | 0.18 | 0.04 | 0.32 | 0.04 | 0.12 | 0.07 | Yes | Yes |
| T501M | 0.32 | 0.07 | 0.35 | 0.07 | 0.17 | 0.29 | Yes | Yes |
| T501V | 0.22 | 0.06 | 0.29 | 0.06 | 0.13 | 0.20 | Yes | Yes |
| T501A | −0.06 | 0.03 | −0.13 | 0.03 | −0.07 | 0.10 | No | No |
| T501R | 0.01 | 0.03 | −0.16 | 0.03 | 0.54 | 0.07 | Yes | No |
| T501N | 0.69 | 0.14 | 0.16 | 0.15 | NA | NA | Yes | No |
| T501D | 0.12 | 0.12 | −0.12 | 0.13 | NA | NA | Yes | No |
| T501C | 0.52 | 0.09 | −0.40 | 0.11 | 0.31 | 0.26 | Yes | No |
| T501Q | −0.19 | 0.10 | −0.04 | 0.10 | −0.24 | 0.31 | No | No |
| T501E | −0.39 | 0.09 | 0.05 | 0.08 | −0.34 | 0.26 | Yes | No |
| T501G | 0.12 | 0.04 | 0.44 | 0.04 | −0.03 | 0.09 | Yes | No |
| T501I | 0.13 | 0.07 | 0.05 | 0.07 | −0.19 | 0.11 | Yes | No |
| T501K | −0.30 | 0.09 | 0.21 | 0.08 | 0.55 | 0.24 | Yes | No |
| T501F | 0.08 | 0.08 | −0.12 | 0.08 | −0.12 | 0.14 | Yes | No |
| T501P | −0.29 | 0.07 | 0.14 | 0.06 | −0.39 | 0.13 | Yes | No |
| T501S | 0.06 | 0.05 | 0.14 | 0.05 | −0.10 | 0.09 | Yes | No |
| T501* | −1.18 | 0.12 | −0.58 | 0.10 | −0.85 | 0.21 | No | No |
| T501W | −0.02 | 0.07 | 0.26 | 0.06 | −0.30 | 0.09 | Yes | No |
| T501Y | −0.08 | 0.12 | 0.11 | 0.12 | −0.29 | 0.29 | Yes | No |
| G502R | 0.14 | 0.05 | 0.28 | 0.05 | 0.98 | 0.07 | Yes | Yes |
| G502E | 0.42 | 0.08 | 0.17 | 0.08 | 0.19 | 0.30 | Yes | Yes |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| G502L | 0.45 | 0.07 | 0.10 | 0.07 | 0.00 | 0.11 | Yes | Yes |
| G502S | 0.08 | 0.06 | 0.23 | 0.06 | 0.16 | 0.12 | Yes | Yes |
| G502W | 0.14 | 0.07 | 0.65 | 0.06 | 0.36 | 0.14 | Yes | Yes |
| G502V | 0.21 | 0.05 | 0.21 | 0.05 | 0.13 | 0.07 | Yes | Yes |
| G502A | −0.05 | 0.05 | −0.34 | 0.05 | 0.08 | 0.07 | Yes | No |
| G502D | −0.14 | 0.08 | 0.37 | 0.07 | 0.10 | 0.15 | Yes | No |
| G502C | −0.17 | 0.08 | 0.23 | 0.08 | −0.04 | 0.13 | Yes | No |
| G502Q | 0.78 | 0.11 | 0.02 | 0.13 | −0.06 | 0.55 | Yes | No |
| G502H | 0.61 | 0.15 | 0.01 | 0.17 | NA | NA | Yes | No |
| G502M | −0.34 | 0.13 | 0.35 | 0.11 | NA | NA | Yes | No |
| G502F | NA | NA | NA | NA | 0.08 | 0.37 | Yes | No |
| G502P | −0.41 | 0.14 | 0.01 | 0.13 | NA | NA | Yes | No |
| G502* | −1.16 | 0.15 | −0.82 | 0.13 | NA | NA | Yes | No |
| G502T | 0.69 | 0.10 | −0.23 | 0.13 | 0.24 | 0.35 | Yes | No |
| I503A | −0.76 | 0.09 | 0.32 | 0.07 | −0.16 | 0.21 | Yes | No |
| I503R | −0.86 | 0.07 | −0.67 | 0.07 | −0.51 | 0.17 | No | No |
| I503N | −0.03 | 0.09 | −0.30 | 0.10 | −0.26 | 0.17 | No | No |
| I503D | −0.50 | 0.13 | −0.57 | 0.13 | NA | NA | Yes | No |
| I503C | −0.24 | 0.11 | 0.84 | 0.09 | 0.00 | 0.33 | Yes | No |
| I503E | NA | NA | NA | NA | −0.71 | 0.36 | Yes | No |
| I503G | −0.69 | 0.06 | −0.30 | 0.05 | −0.53 | 0.15 | No | No |
| I503L | 0.13 | 0.06 | −0.46 | 0.07 | −0.31 | 0.15 | Yes | No |
| I503K | 0.03 | 0.12 | −0.51 | 0.15 | NA | NA | Yes | No |
| I503M | −0.08 | 0.10 | −0.17 | 0.10 | −0.13 | 0.27 | No | No |
| I503F | −0.17 | 0.09 | −0.17 | 0.09 | −0.25 | 0.19 | No | No |
| I503S | −0.45 | 0.07 | −0.27 | 0.07 | −0.23 | 0.19 | No | No |
| I503T | −0.23 | 0.08 | 0.33 | 0.07 | 0.20 | 0.14 | Yes | No |
| I503W | −1.21 | 0.11 | −0.88 | 0.10 | −0.61 | 0.28 | No | No |
| I503V | −0.09 | 0.05 | 0.34 | 0.04 | −0.03 | 0.09 | Yes | No |
| K504A | −0.15 | 0.07 | −0.33 | 0.07 | −0.30 | 0.20 | No | No |
| K504R | −0.05 | 0.03 | 0.04 | 0.03 | −0.08 | 0.06 | Yes | No |
| K504N | 0.01 | 0.03 | −0.54 | 0.04 | −0.50 | 0.04 | Yes | No |
| K504C | −0.46 | 0.13 | 0.02 | 0.12 | NA | NA | Yes | No |
| K504Q | −0.16 | 0.05 | −0.25 | 0.05 | −0.22 | 0.07 | No | No |
| K504E | −0.03 | 0.05 | −0.32 | 0.06 | −0.65 | 0.11 | No | No |
| K504G | −0.84 | 0.05 | −0.46 | 0.05 | −0.52 | 0.15 | No | No |
| K504H | −0.59 | 0.13 | −0.01 | 0.11 | −0.51 | 0.16 | No | No |
| K504I | −0.07 | 0.08 | 0.12 | 0.07 | −0.31 | 0.14 | Yes | No |
| K504L | −0.39 | 0.05 | −0.05 | 0.05 | −0.10 | 0.14 | No | No |
| K504M | −0.32 | 0.08 | −0.06 | 0.08 | −0.06 | 0.10 | No | No |
| K504F | −0.71 | 0.14 | −0.24 | 0.12 | NA | NA | Yes | No |
| K504S | −0.50 | 0.08 | −0.45 | 0.08 | −0.19 | 0.23 | No | No |
| K504* | −0.43 | 0.09 | −0.59 | 0.10 | −0.76 | 0.15 | No | No |
| K504T | −0.22 | 0.08 | 0.08 | 0.07 | −0.15 | 0.14 | Yes | No |
| K504W | −0.48 | 0.08 | 0.09 | 0.07 | −0.53 | 0.24 | Yes | No |
| K504V | −0.48 | 0.05 | −0.27 | 0.05 | −0.36 | 0.12 | No | No |
| L505A | 0.61 | 0.05 | 0.50 | 0.05 | 0.47 | 0.13 | Yes | Yes |
| L505R | 0.40 | 0.03 | 0.56 | 0.03 | 0.81 | 0.05 | Yes | Yes |
| L505Q | 0.30 | 0.07 | 0.82 | 0.07 | 0.16 | 0.11 | Yes | Yes |
| L505E | 0.18 | 0.06 | 0.03 | 0.07 | 0.14 | 0.21 | Yes | Yes |
| L505G | 0.18 | 0.03 | 0.72 | 0.03 | 0.40 | 0.05 | Yes | Yes |
| L505H | 0.33 | 0.11 | 0.83 | 0.10 | 0.34 | 0.32 | Yes | Yes |
| L505K | 0.02 | 0.10 | 1.00 | 0.08 | 1.00 | 0.13 | Yes | Yes |
| L505S | 0.13 | 0.06 | 0.32 | 0.06 | 0.60 | 0.07 | Yes | Yes |
| L505N | −0.53 | 0.17 | 0.27 | 0.14 | NA | NA | Yes | No |
| L505D | −0.28 | 0.11 | 0.59 | 0.10 | 0.10 | 0.49 | Yes | No |
| L505C | 0.26 | 0.07 | −0.14 | 0.08 | 0.47 | 0.27 | Yes | No |
| L505M | −0.05 | 0.09 | −0.06 | 0.09 | −0.18 | 0.18 | No | No |
| L505F | −0.97 | 0.15 | 0.28 | 0.11 | −0.33 | 0.41 | Yes | No |
| L505P | −0.55 | 0.07 | −0.09 | 0.06 | −0.09 | 0.11 | No | No |
| L505T | −0.23 | 0.09 | 0.44 | 0.08 | 0.59 | 0.17 | Yes | No |
| L505W | −0.03 | 0.06 | 0.28 | 0.05 | −0.19 | 0.17 | Yes | No |
| L505V | −0.03 | 0.04 | 0.15 | 0.04 | 0.45 | 0.11 | Yes | No |
| E506A | 0.33 | 0.03 | 0.47 | 0.03 | 0.70 | 0.05 | Yes | Yes |
| E506R | 0.46 | 0.03 | 0.81 | 0.03 | 1.20 | 0.04 | Yes | Yes |
| E506N | 0.24 | 0.09 | 0.53 | 0.09 | 0.50 | 0.29 | Yes | Yes |
| E506C | 0.20 | 0.06 | 0.29 | 0.06 | 0.49 | 0.19 | Yes | Yes |
| E506Q | 0.09 | 0.07 | 0.74 | 0.06 | 0.33 | 0.15 | Yes | Yes |
| E506G | 0.24 | 0.02 | 0.39 | 0.02 | 0.53 | 0.03 | Yes | Yes |
| E506H | 0.35 | 0.09 | 0.10 | 0.10 | 0.98 | 0.31 | Yes | Yes |
| E506I | 0.47 | 0.09 | 0.45 | 0.09 | 0.69 | 0.13 | Yes | Yes |
| E506L | 0.30 | 0.04 | 0.61 | 0.04 | 0.56 | 0.07 | Yes | Yes |
| E506K | 0.18 | 0.06 | 0.59 | 0.05 | 1.08 | 0.08 | Yes | Yes |
| E506M | 0.53 | 0.06 | 0.28 | 0.07 | 0.47 | 0.17 | Yes | Yes |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| E506S | 0.01 | 0.05 | 0.47 | 0.04 | 0.50 | 0.06 | Yes | Yes |
| E506T | 0.39 | 0.06 | 0.12 | 0.07 | 0.90 | 0.23 | Yes | Yes |
| E506Y | 0.16 | 0.09 | 0.29 | 0.09 | 0.43 | 0.25 | Yes | Yes |
| E506V | 0.45 | 0.03 | 0.51 | 0.03 | 0.75 | 0.05 | Yes | Yes |
| E506D | 0.19 | 0.04 | −0.30 | 0.05 | −0.08 | 0.08 | Yes | No |
| E506F | −0.21 | 0.10 | 0.47 | 0.08 | 0.20 | 0.25 | Yes | No |
| E506P | −0.07 | 0.08 | 0.37 | 0.07 | 0.52 | 0.26 | Yes | No |
| E506* | −0.79 | 0.08 | −0.79 | 0.08 | −1.11 | 0.07 | No | No |
| E506W | 0.43 | 0.04 | 0.10 | 0.04 | −0.07 | 0.05 | Yes | No |
| M507A | −0.47 | 0.06 | −0.34 | 0.06 | −0.32 | 0.19 | No | No |
| M507R | −0.42 | 0.02 | −0.58 | 0.03 | −0.64 | 0.04 | No | No |
| M507C | −0.41 | 0.09 | −0.31 | 0.09 | 0.15 | 0.28 | Yes | No |
| M507Q | −0.68 | 0.07 | −0.56 | 0.07 | −0.44 | 0.17 | No | No |
| M507E | NA | NA | NA | NA | −1.23 | 0.19 | Yes | No |
| M507G | −0.98 | 0.05 | −0.71 | 0.05 | −1.24 | 0.12 | No | No |
| M507H | −0.65 | 0.12 | 0.68 | 0.09 | −0.86 | 0.28 | Yes | No |
| M507I | −0.06 | 0.04 | −0.12 | 0.04 | 0.01 | 0.07 | Yes | No |
| M507L | −0.20 | 0.03 | −0.35 | 0.03 | −0.16 | 0.03 | No | No |
| M507K | −1.42 | 0.13 | −0.06 | 0.09 | −1.00 | 0.19 | No | No |
| M507F | 0.05 | 0.09 | −0.78 | 0.12 | −0.05 | 0.36 | Yes | No |
| M507P | −2.08 | 0.12 | −2.19 | 0.13 | −1.58 | 0.18 | No | No |
| M507S | −1.03 | 0.09 | −0.34 | 0.07 | −0.46 | 0.18 | No | No |
| M507* | −1.68 | 0.15 | −0.72 | 0.11 | NA | NA | Yes | No |
| M507T | −0.11 | 0.06 | −0.30 | 0.07 | −0.03 | 0.13 | No | No |
| M507W | −0.94 | 0.08 | −0.59 | 0.07 | −0.82 | 0.18 | No | No |
| M507V | −0.17 | 0.03 | 0.06 | 0.03 | −0.28 | 0.06 | Yes | No |
| E508A | 0.36 | 0.03 | 0.20 | 0.03 | 0.18 | 0.06 | Yes | Yes |
| E508R | 0.54 | 0.03 | 0.80 | 0.03 | 0.82 | 0.06 | Yes | Yes |
| E508Q | 0.25 | 0.06 | 0.11 | 0.07 | 0.51 | 0.13 | Yes | Yes |
| E508G | 0.16 | 0.02 | 0.17 | 0.02 | 0.22 | 0.04 | Yes | Yes |
| E508L | 0.03 | 0.04 | 0.10 | 0.04 | 0.26 | 0.11 | Yes | Yes |
| E508K | 0.20 | 0.06 | 0.49 | 0.06 | 0.66 | 0.08 | Yes | Yes |
| E508M | 0.25 | 0.07 | 0.57 | 0.06 | 0.54 | 0.11 | Yes | Yes |
| E508F | 0.27 | 0.08 | 0.19 | 0.08 | 0.39 | 0.29 | Yes | Yes |
| E508S | 0.31 | 0.05 | 0.62 | 0.04 | 0.34 | 0.06 | Yes | Yes |
| E508T | 0.19 | 0.06 | 0.73 | 0.06 | 0.55 | 0.10 | Yes | Yes |
| E508Y | 0.35 | 0.09 | 0.19 | 0.10 | 0.21 | 0.27 | Yes | Yes |
| E508V | 0.16 | 0.03 | 0.22 | 0.03 | 0.34 | 0.05 | Yes | Yes |
| E508N | −0.08 | 0.11 | −0.10 | 0.11 | 0.55 | 0.20 | Yes | No |
| E508D | 0.09 | 0.04 | −0.15 | 0.04 | −0.16 | 0.06 | Yes | No |
| E508C | −0.15 | 0.08 | 0.18 | 0.07 | 0.02 | 0.24 | Yes | No |
| E508H | −0.25 | 0.11 | 0.57 | 0.09 | 0.65 | 0.24 | Yes | No |
| E508I | 0.29 | 0.09 | −0.12 | 0.10 | 0.54 | 0.15 | Yes | No |
| E508P | −0.52 | 0.08 | −0.67 | 0.08 | −0.63 | 0.20 | No | No |
| E508* | −0.63 | 0.06 | −0.82 | 0.07 | −0.79 | 0.09 | No | No |
| E508W | −0.29 | 0.05 | 0.45 | 0.05 | 0.07 | 0.09 | Yes | No |
| P509R | 0.23 | 0.03 | 0.27 | 0.03 | 1.04 | 0.05 | Yes | Yes |
| P509K | 0.01 | 0.07 | 0.12 | 0.07 | 1.29 | 0.13 | Yes | Yes |
| P509M | 0.34 | 0.07 | 0.34 | 0.07 | 0.10 | 0.22 | Yes | Yes |
| P509S | 0.10 | 0.04 | 0.14 | 0.04 | 0.14 | 0.10 | Yes | Yes |
| P509W | 0.04 | 0.05 | 0.33 | 0.05 | 0.61 | 0.18 | Yes | Yes |
| P509Y | 0.18 | 0.09 | 0.20 | 0.09 | 0.53 | 0.30 | Yes | Yes |
| P509A | 0.45 | 0.04 | −0.19 | 0.04 | −0.04 | 0.05 | Yes | No |
| P509N | 0.18 | 0.09 | −0.33 | 0.11 | 0.63 | 0.29 | Yes | No |
| P509D | −0.12 | 0.08 | −0.12 | 0.08 | −0.01 | 0.21 | No | No |
| P509C | 0.00 | 0.06 | −0.37 | 0.07 | 0.05 | 0.20 | Yes | No |
| P509Q | 0.08 | 0.05 | −0.10 | 0.06 | 0.36 | 0.08 | Yes | No |
| P509E | −0.27 | 0.06 | 0.33 | 0.05 | 0.38 | 0.17 | Yes | No |
| P509G | −0.06 | 0.03 | 0.19 | 0.03 | 0.00 | 0.05 | Yes | No |
| P509H | 0.09 | 0.03 | −0.31 | 0.03 | −0.19 | 0.05 | Yes | No |
| P509I | −0.10 | 0.09 | −0.34 | 0.10 | −0.56 | 0.28 | No | No |
| P509L | 0.11 | 0.04 | 0.17 | 0.04 | −0.17 | 0.05 | Yes | No |
| P509F | −0.12 | 0.09 | 0.24 | 0.08 | 0.52 | 0.11 | Yes | No |
| P509* | −2.22 | 0.15 | −0.93 | 0.09 | NA | NA | Yes | No |
| P509T | 0.10 | 0.06 | 0.58 | 0.05 | −0.04 | 0.11 | Yes | No |
| P509V | 0.09 | 0.04 | 0.07 | 0.04 | −0.45 | 0.08 | Yes | No |
| S510G | 0.18 | 0.03 | 0.49 | 0.03 | 0.21 | 0.06 | Yes | Yes |
| S510L | 0.57 | 0.06 | 0.72 | 0.06 | 0.74 | 0.09 | Yes | Yes |
| S510A | 0.29 | 0.06 | −0.25 | 0.07 | 0.04 | 0.22 | Yes | No |
| S510R | −0.38 | 0.03 | −0.43 | 0.03 | −0.53 | 0.04 | No | No |
| S510N | −0.36 | 0.09 | −0.11 | 0.09 | 0.06 | 0.17 | Yes | No |
| S510D | −1.40 | 0.15 | −1.36 | 0.15 | NA | NA | Yes | No |
| S510C | −0.14 | 0.06 | 0.03 | 0.06 | 0.28 | 0.14 | Yes | No |
| S510E | −0.71 | 0.09 | −1.10 | 0.11 | −1.07 | 0.25 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| S510I | 0.02 | 0.05 | −0.39 | 0.06 | −0.76 | 0.03 | Yes | No |
| S510M | −1.15 | 0.14 | −0.15 | 0.10 | 0.36 | 0.23 | Yes | No |
| S510F | −0.15 | 0.12 | 0.48 | 0.11 | NA | NA | Yes | No |
| S510* | −1.11 | 0.13 | −1.36 | 0.15 | NA | NA | Yes | No |
| S510T | 0.18 | 0.08 | 0.64 | 0.08 | −0.17 | 0.16 | Yes | No |
| S510W | −0.06 | 0.06 | −0.94 | 0.08 | −0.37 | 0.17 | No | No |
| S510V | −0.05 | 0.05 | 0.44 | 0.05 | 0.44 | 0.18 | Yes | No |
| L511A | 0.07 | 0.10 | −0.06 | 0.11 | −0.31 | 0.15 | Yes | No |
| L511R | 0.00 | 0.03 | −0.21 | 0.04 | 0.09 | 0.06 | Yes | No |
| L511Q | −0.72 | 0.15 | 0.45 | 0.11 | NA | NA | Yes | No |
| L511E | −0.31 | 0.12 | −0.25 | 0.13 | −0.81 | 0.34 | No | No |
| L511G | −0.42 | 0.07 | 0.08 | 0.06 | −0.02 | 0.27 | Yes | No |
| L511K | 0.26 | 0.13 | 0.44 | 0.12 | NA | NA | Yes | No |
| L511M | −0.67 | 0.11 | 0.33 | 0.08 | 0.25 | 0.20 | Yes | No |
| L511P | 0.04 | 0.08 | 0.00 | 0.09 | 0.26 | 0.13 | Yes | No |
| L511S | −0.12 | 0.12 | −0.37 | 0.13 | 0.02 | 0.33 | Yes | No |
| L511W | 0.61 | 0.08 | 0.02 | 0.09 | −0.40 | 0.38 | Yes | No |
| L511V | −0.26 | 0.06 | 0.38 | 0.06 | −0.02 | 0.16 | Yes | No |
| S512R | 0.07 | 0.07 | 0.34 | 0.07 | 0.07 | 0.19 | Yes | Yes |
| S512A | 0.11 | 0.05 | −0.15 | 0.06 | −0.16 | 0.06 | Yes | No |
| S512N | −0.12 | 0.19 | 0.58 | 0.16 | NA | NA | Yes | No |
| S512D | −0.14 | 0.12 | −0.33 | 0.13 | 0.47 | 0.39 | Yes | No |
| S512C | 0.06 | 0.08 | 0.61 | 0.08 | −0.18 | 0.19 | Yes | No |
| S512E | 0.44 | 0.10 | −0.11 | 0.12 | 0.21 | 0.36 | Yes | No |
| S512G | −0.15 | 0.05 | −0.15 | 0.05 | 0.10 | 0.12 | Yes | No |
| S512L | −0.16 | 0.10 | 0.53 | 0.09 | −0.21 | 0.20 | Yes | No |
| S512K | 0.65 | 0.15 | 0.57 | 0.15 | NA | NA | Yes | No |
| S512M | 0.28 | 0.14 | 0.24 | 0.15 | NA | NA | Yes | No |
| S512F | −0.28 | 0.08 | −0.16 | 0.08 | −0.32 | 0.13 | No | No |
| S512P | −0.22 | 0.08 | −0.09 | 0.08 | −0.16 | 0.13 | No | No |
| S512T | −0.17 | 0.09 | 0.05 | 0.08 | −0.07 | 0.15 | Yes | No |
| S512W | −0.13 | 0.10 | 0.13 | 0.10 | NA | NA | Yes | No |
| S512Y | −0.26 | 0.13 | −0.68 | 0.15 | NA | NA | Yes | No |
| S512V | −0.38 | 0.08 | −0.54 | 0.09 | −0.64 | 0.19 | No | No |
| F513L | 0.53 | 0.04 | 0.63 | 0.04 | 0.41 | 0.07 | Yes | Yes |
| F513W | 0.04 | 0.06 | 0.35 | 0.06 | 0.28 | 0.13 | Yes | Yes |
| F513A | −1.58 | 0.11 | 0.20 | 0.06 | −0.49 | 0.25 | Yes | No |
| F513R | −1.56 | 0.09 | −1.47 | 0.09 | −0.89 | 0.06 | No | No |
| F513D | −1.02 | 0.15 | 0.12 | 0.11 | NA | NA | Yes | No |
| F513C | −0.83 | 0.10 | −0.27 | 0.09 | −0.27 | 0.14 | No | No |
| F513Q | 0.00 | 0.13 | 0.58 | 0.12 | NA | NA | Yes | No |
| F513E | −0.37 | 0.09 | 0.33 | 0.08 | −0.38 | 0.38 | Yes | No |
| F513G | −1.33 | 0.06 | −0.80 | 0.05 | −1.00 | 0.13 | No | No |
| F513I | 0.78 | 0.10 | 0.21 | 0.11 | NA | NA | Yes | No |
| F513M | −0.36 | 0.12 | 0.73 | 0.10 | 0.49 | 0.23 | Yes | No |
| F513S | −0.59 | 0.07 | −0.47 | 0.07 | −0.61 | 0.10 | No | No |
| F513T | NA | NA | NA | NA | −0.35 | 0.19 | Yes | No |
| F513Y | −0.10 | 0.10 | 0.26 | 0.09 | 0.44 | 0.12 | Yes | No |
| F513V | −0.53 | 0.06 | −0.27 | 0.06 | 0.06 | 0.19 | Yes | No |
| Y514A | −0.28 | 0.05 | −0.43 | 0.05 | −0.73 | 0.13 | No | No |
| Y514R | −0.23 | 0.04 | −0.47 | 0.05 | −0.86 | 0.14 | No | No |
| Y514N | −0.17 | 0.09 | 0.07 | 0.08 | −0.53 | 0.17 | Yes | No |
| Y514D | −1.11 | 0.10 | −1.20 | 0.11 | −1.22 | 0.16 | No | No |
| Y514C | −0.39 | 0.05 | −0.35 | 0.05 | −0.55 | 0.09 | No | No |
| Y514Q | −1.35 | 0.13 | −0.62 | 0.10 | −1.01 | 0.29 | No | No |
| Y514E | −1.08 | 0.08 | −0.93 | 0.08 | −1.50 | 0.19 | No | No |
| Y514G | −0.76 | 0.04 | −0.49 | 0.04 | −1.06 | 0.11 | No | No |
| Y514H | 0.39 | 0.06 | 0.29 | 0.06 | −0.31 | 0.12 | Yes | No |
| Y514I | −0.14 | 0.09 | −0.84 | 0.11 | NA | NA | Yes | No |
| Y514L | −0.37 | 0.05 | −0.57 | 0.05 | −0.73 | 0.10 | No | No |
| Y514K | −0.52 | 0.09 | −1.28 | 0.12 | NA | NA | Yes | No |
| Y514M | −0.50 | 0.07 | −0.38 | 0.07 | −0.59 | 0.19 | No | No |
| Y514F | −0.29 | 0.07 | 0.14 | 0.06 | −0.35 | 0.11 | Yes | No |
| Y514S | −0.33 | 0.05 | −0.32 | 0.05 | −0.86 | 0.11 | No | No |
| Y514* | −0.91 | 0.08 | −1.20 | 0.10 | −1.18 | 0.13 | No | No |
| Y514T | −1.01 | 0.09 | −1.31 | 0.10 | −0.98 | 0.18 | No | No |
| Y514W | 0.17 | 0.05 | 0.46 | 0.05 | −0.09 | 0.23 | Yes | No |
| Y514V | −0.45 | 0.04 | −0.41 | 0.04 | −0.92 | 0.06 | No | No |
| N515A | 0.60 | 0.06 | 0.82 | 0.06 | 0.12 | 0.11 | Yes | Yes |
| N515R | 0.63 | 0.06 | 0.82 | 0.05 | 0.19 | 0.11 | Yes | Yes |
| N515I | 0.23 | 0.07 | 0.30 | 0.07 | 0.16 | 0.14 | Yes | Yes |
| N515L | 0.33 | 0.06 | 0.53 | 0.06 | 0.07 | 0.20 | Yes | Yes |
| N515T | 0.41 | 0.08 | 0.14 | 0.08 | 0.29 | 0.16 | Yes | Yes |
| N515V | 0.50 | 0.05 | 0.49 | 0.05 | 0.45 | 0.09 | Yes | Yes |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| N515D | 0.05 | 0.06 | −0.17 | 0.06 | −0.30 | 0.10 | Yes | No |
| N515C | 0.59 | 0.12 | 0.62 | 0.12 | −0.02 | 0.30 | Yes | No |
| N515Q | 0.46 | 0.11 | 0.69 | 0.11 | NA | NA | Yes | No |
| N515E | 0.47 | 0.07 | 0.56 | 0.07 | −0.14 | 0.19 | Yes | No |
| N515G | −0.10 | 0.05 | 0.37 | 0.04 | −0.13 | 0.07 | Yes | No |
| N515H | 0.09 | 0.10 | −0.59 | 0.13 | −0.25 | 0.21 | Yes | No |
| N515K | 0.07 | 0.08 | 0.16 | 0.08 | −0.13 | 0.16 | Yes | No |
| N515M | 0.73 | 0.09 | 0.45 | 0.10 | −0.01 | 0.12 | Yes | No |
| N515F | 0.49 | 0.12 | 0.48 | 0.12 | NA | NA | Yes | No |
| N515P | −1.10 | 0.16 | −0.13 | 0.12 | −0.32 | 0.38 | No | No |
| N515S | 0.08 | 0.05 | −0.15 | 0.05 | 0.19 | 0.08 | Yes | No |
| N515W | 0.79 | 0.08 | 0.42 | 0.09 | −0.60 | 0.31 | Yes | No |
| N515Y | −0.30 | 0.12 | −0.55 | 0.13 | 0.03 | 0.22 | Yes | No |
| K516R | 0.01 | 0.03 | 0.26 | 0.03 | 0.40 | 0.06 | Yes | Yes |
| K516A | 0.25 | 0.05 | 0.13 | 0.06 | −0.33 | 0.21 | Yes | No |
| K516N | 0.37 | 0.09 | 0.01 | 0.11 | −0.01 | 0.16 | Yes | No |
| K516D | NA | NA | NA | NA | −0.48 | 0.31 | Yes | No |
| K516C | −1.37 | 0.13 | 0.14 | 0.08 | −0.36 | 0.16 | Yes | No |
| K516Q | 0.08 | 0.07 | −0.76 | 0.10 | −0.08 | 0.16 | Yes | No |
| K516E | −0.23 | 0.04 | −0.32 | 0.05 | −0.33 | 0.09 | No | No |
| K516G | −0.34 | 0.03 | −0.01 | 0.03 | −0.34 | 0.05 | No | No |
| K516I | −0.29 | 0.14 | −0.03 | 0.14 | NA | NA | Yes | No |
| K516L | −0.29 | 0.06 | −0.06 | 0.06 | −0.56 | 0.18 | No | No |
| K516M | −0.29 | 0.08 | −0.21 | 0.08 | −0.31 | 0.17 | No | No |
| K516P | −0.37 | 0.10 | −0.96 | 0.12 | NA | NA | Yes | No |
| K516S | −0.34 | 0.06 | 0.23 | 0.06 | −0.22 | 0.21 | Yes | No |
| K516* | −0.66 | 0.09 | −0.86 | 0.10 | −1.08 | 0.19 | No | No |
| K516T | −0.18 | 0.04 | −0.43 | 0.04 | −0.09 | 0.06 | No | No |
| K516W | −0.42 | 0.06 | −0.55 | 0.07 | −1.18 | 0.16 | No | No |
| K516V | −0.47 | 0.05 | −0.20 | 0.05 | −1.04 | 0.11 | No | No |
| A517R | −2.02 | 0.07 | −1.56 | 0.06 | −1.46 | 0.07 | No | No |
| A517D | −1.35 | 0.11 | −0.85 | 0.09 | −1.19 | 0.18 | No | No |
| A517C | −0.35 | 0.08 | 0.68 | 0.07 | 0.14 | 0.17 | Yes | No |
| A517E | −1.34 | 0.09 | −1.16 | 0.09 | −1.86 | 0.16 | No | No |
| A517G | −0.69 | 0.03 | −0.65 | 0.03 | −0.77 | 0.04 | No | No |
| A517I | 0.77 | 0.10 | −0.42 | 0.13 | NA | NA | Yes | No |
| A517L | −0.30 | 0.06 | −0.44 | 0.06 | −1.22 | 0.17 | No | No |
| A517M | −0.50 | 0.10 | −0.24 | 0.10 | −0.57 | 0.30 | No | No |
| A517F | −0.50 | 0.12 | −0.90 | 0.14 | NA | NA | Yes | No |
| A517P | −0.75 | 0.08 | −1.06 | 0.09 | −0.86 | 0.12 | No | No |
| A517S | −0.28 | 0.05 | −0.24 | 0.05 | −0.65 | 0.14 | No | No |
| A517T | −0.34 | 0.06 | 0.06 | 0.06 | −0.42 | 0.11 | Yes | No |
| A517W | −1.22 | 0.07 | −0.27 | 0.05 | −1.43 | 0.16 | No | No |
| A517Y | 0.02 | 0.13 | 0.04 | 0.13 | NA | NA | Yes | No |
| A517V | −0.33 | 0.04 | −0.14 | 0.04 | −0.44 | 0.07 | No | No |
| R518K | 0.20 | 0.09 | 0.72 | 0.08 | 0.05 | 0.17 | Yes | Yes |
| R518A | −0.12 | 0.07 | −0.28 | 0.07 | −0.87 | 0.24 | No | No |
| R518C | −1.13 | 0.12 | −0.21 | 0.09 | NA | NA | Yes | No |
| R518E | −0.72 | 0.10 | −1.08 | 0.12 | NA | NA | Yes | No |
| R518G | −1.34 | 0.05 | −0.78 | 0.04 | −0.87 | 0.08 | No | No |
| R518L | −1.49 | 0.12 | −1.84 | 0.15 | NA | NA | Yes | No |
| R518F | −0.96 | 0.16 | 0.45 | 0.11 | NA | NA | Yes | No |
| R518S | −0.74 | 0.08 | −1.20 | 0.09 | −0.73 | 0.12 | No | No |
| R518* | −0.33 | 0.08 | −0.34 | 0.08 | −0.69 | 0.13 | No | No |
| R518T | −0.50 | 0.10 | −0.37 | 0.10 | −0.40 | 0.15 | No | No |
| R518W | −1.01 | 0.09 | −1.13 | 0.10 | −1.22 | 0.19 | No | No |
| R518V | −0.44 | 0.06 | −1.39 | 0.09 | −1.43 | 0.09 | No | No |
| N519A | 0.64 | 0.06 | 1.07 | 0.06 | −0.06 | 0.25 | Yes | No |
| N519R | 0.47 | 0.05 | 0.46 | 0.05 | −0.02 | 0.08 | Yes | No |
| N519D | 0.10 | 0.05 | −0.13 | 0.05 | −0.29 | 0.07 | Yes | No |
| N519C | 0.21 | 0.11 | 0.23 | 0.11 | NA | NA | Yes | No |
| N519Q | 0.14 | 0.12 | 0.71 | 0.11 | NA | NA | Yes | No |
| N519E | −0.66 | 0.10 | −0.38 | 0.09 | −0.89 | 0.23 | No | No |
| N519G | 0.21 | 0.04 | 0.10 | 0.04 | −0.54 | 0.08 | Yes | No |
| N519H | 0.10 | 0.09 | −0.67 | 0.11 | NA | NA | Yes | No |
| N519I | 0.29 | 0.09 | 0.18 | 0.09 | −0.02 | 0.15 | Yes | No |
| N519L | 0.28 | 0.06 | 0.47 | 0.06 | −0.37 | 0.08 | Yes | No |
| N519K | −0.17 | 0.09 | −0.35 | 0.10 | −0.46 | 0.19 | No | No |
| N519M | −0.19 | 0.10 | 0.36 | 0.09 | −0.05 | 0.13 | Yes | No |
| N519F | 0.38 | 0.14 | 0.21 | 0.15 | NA | NA | Yes | No |
| N519P | −0.72 | 0.13 | −0.23 | 0.11 | NA | NA | Yes | No |
| N519S | 0.08 | 0.05 | −0.03 | 0.05 | 0.02 | 0.12 | Yes | No |
| N519T | 0.24 | 0.08 | 0.01 | 0.09 | −0.37 | 0.16 | Yes | No |
| N519W | −0.02 | 0.08 | 0.38 | 0.08 | −0.12 | 0.31 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| N519Y | 0.10 | 0.12 | 0.65 | 0.11 | −0.09 | 0.22 | Yes | No |
| N519V | 0.12 | 0.05 | 0.14 | 0.05 | −0.39 | 0.06 | Yes | No |
| Y520A | −1.19 | 0.12 | −0.30 | 0.09 | NA | NA | Yes | No |
| Y520R | −0.37 | 0.08 | −1.30 | 0.11 | −1.04 | 0.24 | No | No |
| Y520N | −0.05 | 0.09 | −0.45 | 0.10 | −0.62 | 0.14 | No | No |
| Y520D | −0.50 | 0.12 | −0.04 | 0.10 | NA | NA | Yes | No |
| Y520C | −0.23 | 0.07 | −0.24 | 0.07 | −0.52 | 0.12 | No | No |
| Y520E | −0.61 | 0.13 | −0.85 | 0.15 | NA | NA | Yes | No |
| Y520G | −1.91 | 0.10 | −1.08 | 0.08 | −1.47 | 0.09 | No | No |
| Y520H | 0.12 | 0.07 | −0.14 | 0.07 | −0.34 | 0.10 | Yes | No |
| Y520F | 0.19 | 0.13 | −0.21 | 0.15 | NA | NA | Yes | No |
| Y520S | −0.73 | 0.11 | −0.66 | 0.11 | −1.13 | 0.18 | No | No |
| Y520* | −0.19 | 0.07 | −0.42 | 0.08 | −0.48 | 0.15 | No | No |
| Y520W | −0.38 | 0.10 | 0.06 | 0.09 | −0.03 | 0.16 | Yes | No |
| Y520V | −1.45 | 0.13 | −1.16 | 0.12 | NA | NA | Yes | No |
| A521D | −0.72 | 0.13 | −0.50 | 0.13 | NA | NA | Yes | No |
| A521C | 0.90 | 0.16 | 1.29 | 0.16 | NA | NA | Yes | No |
| A521G | −0.52 | 0.05 | −0.73 | 0.06 | −0.98 | 0.12 | No | No |
| A521L | −0.61 | 0.10 | −0.13 | 0.09 | −0.98 | 0.12 | No | No |
| A521P | −0.19 | 0.11 | −0.78 | 0.14 | NA | NA | Yes | No |
| A521S | 0.00 | 0.09 | 0.04 | 0.10 | −0.51 | 0.27 | Yes | No |
| A521T | −0.23 | 0.07 | 0.10 | 0.06 | −0.33 | 0.11 | Yes | No |
| A521V | −0.40 | 0.06 | −0.88 | 0.07 | −0.60 | 0.13 | No | No |
| T522L | 1.10 | 0.05 | 0.92 | 0.05 | 0.28 | 0.10 | Yes | Yes |
| T522M | 0.92 | 0.07 | 0.81 | 0.08 | 0.53 | 0.21 | Yes | Yes |
| T522V | 0.16 | 0.05 | 0.28 | 0.05 | 0.04 | 0.07 | Yes | Yes |
| T522A | −0.01 | 0.05 | −0.37 | 0.06 | −0.55 | 0.08 | No | No |
| T522R | −0.17 | 0.04 | 0.31 | 0.04 | −0.40 | 0.12 | Yes | No |
| T522N | 0.11 | 0.07 | −1.14 | 0.11 | −0.50 | 0.13 | Yes | No |
| T522C | 0.09 | 0.08 | 0.38 | 0.08 | −0.41 | 0.38 | Yes | No |
| T522Q | 0.71 | 0.09 | 0.47 | 0.10 | −0.51 | 0.36 | Yes | No |
| T522E | −0.22 | 0.08 | −1.54 | 0.13 | −0.72 | 0.27 | No | No |
| T522G | −0.37 | 0.04 | −0.18 | 0.04 | −0.85 | 0.08 | No | No |
| T522I | 0.23 | 0.07 | −0.06 | 0.08 | −0.11 | 0.17 | Yes | No |
| T522K | −0.16 | 0.11 | −0.23 | 0.11 | −0.67 | 0.26 | No | No |
| T522F | 0.08 | 0.13 | 0.34 | 0.12 | NA | NA | Yes | No |
| T522P | −1.16 | 0.11 | −1.52 | 0.14 | −1.14 | 0.16 | No | No |
| T522S | 0.23 | 0.05 | −0.20 | 0.05 | −0.38 | 0.10 | Yes | No |
| T522W | −0.26 | 0.07 | −0.35 | 0.07 | −0.90 | 0.13 | No | No |
| K523R | 0.17 | 0.02 | 0.37 | 0.02 | 0.00 | 0.03 | Yes | Yes |
| K523A | −0.19 | 0.03 | 0.15 | 0.03 | −0.48 | 0.09 | Yes | No |
| K523N | −0.31 | 0.07 | −0.48 | 0.07 | −1.00 | 0.08 | No | No |
| K523D | −1.14 | 0.07 | −1.35 | 0.08 | −1.21 | 0.09 | No | No |
| K523C | −0.22 | 0.05 | 0.07 | 0.04 | −0.81 | 0.12 | Yes | No |
| K523Q | −0.12 | 0.04 | −0.22 | 0.04 | 0.01 | 0.06 | Yes | No |
| K523E | −0.57 | 0.04 | −0.56 | 0.04 | −0.86 | 0.06 | No | No |
| K523G | −0.16 | 0.02 | 0.09 | 0.02 | −0.56 | 0.03 | Yes | No |
| K523H | −1.08 | 0.11 | −0.05 | 0.08 | −1.04 | 0.28 | No | No |
| K523I | −0.20 | 0.07 | 0.41 | 0.06 | −1.23 | 0.21 | Yes | No |
| K523L | −0.78 | 0.04 | −0.30 | 0.03 | −0.70 | 0.07 | No | No |
| K523M | −0.19 | 0.04 | −0.18 | 0.04 | −0.52 | 0.06 | No | No |
| K523F | −1.08 | 0.08 | −0.93 | 0.08 | −1.27 | 0.09 | No | No |
| K523P | −1.41 | 0.08 | −0.39 | 0.06 | −1.21 | 0.15 | No | No |
| K523S | 0.13 | 0.03 | 0.10 | 0.03 | −0.36 | 0.07 | Yes | No |
| K523* | −1.40 | 0.07 | −1.46 | 0.08 | −1.19 | 0.12 | No | No |
| K523T | −0.19 | 0.04 | −0.19 | 0.04 | −0.49 | 0.08 | No | No |
| K523W | −0.97 | 0.04 | −0.87 | 0.04 | −1.41 | 0.09 | No | No |
| K523Y | −1.25 | 0.10 | −0.43 | 0.08 | −1.36 | 0.19 | No | No |
| K523V | −0.57 | 0.03 | −0.57 | 0.03 | −1.12 | 0.08 | No | No |
| K524A | −0.88 | 0.09 | −0.32 | 0.08 | −0.50 | 0.24 | No | No |
| K524R | −0.32 | 0.04 | 0.15 | 0.04 | −0.28 | 0.09 | Yes | No |
| K524N | 0.04 | 0.04 | −0.48 | 0.05 | −0.19 | 0.09 | Yes | No |
| K524C | 0.06 | 0.10 | 0.03 | 0.10 | NA | NA | Yes | No |
| K524Q | −0.42 | 0.09 | −0.54 | 0.10 | −0.47 | 0.14 | No | No |
| K524E | −0.53 | 0.06 | −0.11 | 0.06 | −0.49 | 0.10 | No | No |
| K524G | −0.43 | 0.04 | −0.19 | 0.04 | −0.80 | 0.06 | No | No |
| K524L | −0.25 | 0.07 | 0.32 | 0.06 | −0.81 | 0.21 | Yes | No |
| K524M | −1.28 | 0.15 | −0.75 | 0.13 | −0.69 | 0.15 | No | No |
| K524P | −0.70 | 0.12 | −0.10 | 0.10 | 0.02 | 0.29 | Yes | No |
| K524S | −0.67 | 0.08 | −0.04 | 0.07 | −0.73 | 0.12 | No | No |
| K524* | −0.92 | 0.11 | −0.75 | 0.11 | −0.76 | 0.13 | No | No |
| K524T | −0.10 | 0.04 | −0.26 | 0.04 | −0.15 | 0.06 | No | No |
| K524W | −0.58 | 0.08 | −1.54 | 0.12 | −1.19 | 0.22 | No | No |
| K524V | −0.71 | 0.07 | −0.01 | 0.06 | −0.68 | 0.22 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| P525A | −0.21 | 0.03 | 0.06 | 0.03 | −0.29 | 0.07 | Yes | No |
| P525R | −0.30 | 0.02 | −0.10 | 0.02 | −0.62 | 0.05 | No | No |
| P525N | −0.38 | 0.09 | −0.35 | 0.10 | −0.10 | 0.19 | No | No |
| P525D | 0.42 | 0.05 | −0.02 | 0.05 | −0.30 | 0.08 | Yes | No |
| P525C | −0.28 | 0.05 | −0.12 | 0.05 | −0.48 | 0.14 | No | No |
| P525Q | −0.21 | 0.06 | −0.19 | 0.06 | −0.35 | 0.13 | No | No |
| P525E | −0.22 | 0.04 | 0.24 | 0.04 | −0.30 | 0.05 | Yes | No |
| P525G | −0.24 | 0.02 | −0.17 | 0.02 | −0.51 | 0.05 | No | No |
| P525H | 0.17 | 0.06 | 0.18 | 0.07 | −0.24 | 0.12 | Yes | No |
| P525I | −0.48 | 0.09 | 0.06 | 0.08 | 0.19 | 0.22 | Yes | No |
| P525L | −0.37 | 0.03 | 0.25 | 0.03 | −0.61 | 0.06 | Yes | No |
| P525K | −0.90 | 0.08 | −1.00 | 0.09 | −0.57 | 0.17 | No | No |
| P525M | −0.55 | 0.06 | −0.18 | 0.06 | −0.54 | 0.13 | No | No |
| P525F | −0.17 | 0.07 | −0.61 | 0.08 | −0.70 | 0.16 | No | No |
| P525S | −0.06 | 0.03 | 0.04 | 0.03 | −0.42 | 0.08 | Yes | No |
| P525* | −1.61 | 0.09 | −1.54 | 0.09 | −1.56 | 0.08 | No | No |
| P525T | −0.25 | 0.05 | −0.31 | 0.05 | −0.45 | 0.11 | No | No |
| P525W | −0.25 | 0.04 | −0.04 | 0.03 | −0.59 | 0.11 | No | No |
| P525Y | −1.08 | 0.10 | −1.08 | 0.10 | −0.77 | 0.08 | No | No |
| P525V | −0.31 | 0.03 | −0.08 | 0.03 | −0.39 | 0.08 | No | No |
| Y526A | −0.28 | 0.07 | 0.17 | 0.06 | −0.89 | 0.19 | Yes | No |
| Y526R | −0.71 | 0.07 | −0.17 | 0.06 | −1.09 | 0.19 | No | No |
| Y526N | −0.64 | 0.11 | −0.15 | 0.09 | −0.25 | 0.17 | No | No |
| Y526D | −0.44 | 0.09 | 0.07 | 0.08 | −0.69 | 0.15 | Yes | No |
| Y526C | 0.04 | 0.06 | −0.03 | 0.06 | −0.26 | 0.12 | Yes | No |
| Y526Q | −0.10 | 0.11 | −0.64 | 0.13 | NA | NA | Yes | No |
| Y526E | −0.46 | 0.08 | −0.87 | 0.10 | −0.84 | 0.21 | No | No |
| Y526G | −0.22 | 0.05 | −0.17 | 0.05 | −0.65 | 0.16 | No | No |
| Y526H | −0.32 | 0.08 | −0.25 | 0.08 | −0.19 | 0.12 | No | No |
| Y526I | −0.40 | 0.13 | −0.52 | 0.14 | NA | NA | Yes | No |
| Y526L | −0.53 | 0.06 | −0.18 | 0.05 | −0.73 | 0.12 | No | No |
| Y526M | −0.47 | 0.10 | −0.40 | 0.10 | −1.12 | 0.27 | No | No |
| Y526F | −0.02 | 0.07 | −0.01 | 0.07 | −0.44 | 0.13 | No | No |
| Y526P | −0.19 | 0.10 | −0.88 | 0.13 | NA | NA | Yes | No |
| Y526S | −0.57 | 0.06 | −0.68 | 0.07 | −0.68 | 0.12 | No | No |
| Y526* | −0.42 | 0.05 | −0.44 | 0.06 | −0.61 | 0.09 | No | No |
| Y526T | −0.01 | 0.09 | −0.22 | 0.10 | −0.69 | 0.21 | No | No |
| Y526W | −1.02 | 0.10 | −0.19 | 0.08 | −0.32 | 0.13 | No | No |
| Y526V | −0.61 | 0.05 | −0.14 | 0.05 | −0.86 | 0.14 | No | No |
| S527D | 0.13 | 0.11 | 0.01 | 0.11 | 0.34 | 0.41 | Yes | Yes |
| S527A | 0.00 | 0.06 | −0.37 | 0.07 | −0.07 | 0.20 | Yes | No |
| S527R | −0.14 | 0.04 | −0.73 | 0.05 | −0.70 | 0.07 | No | No |
| S527N | −0.10 | 0.10 | −0.43 | 0.11 | 0.01 | 0.19 | Yes | No |
| S527C | −0.21 | 0.09 | −0.35 | 0.09 | −0.10 | 0.22 | No | No |
| S527Q | 0.09 | 0.12 | −0.39 | 0.14 | NA | NA | Yes | No |
| S527E | −0.49 | 0.10 | 0.57 | 0.08 | 0.03 | 0.16 | Yes | No |
| S527G | −0.43 | 0.04 | −0.21 | 0.04 | −0.53 | 0.09 | No | No |
| S527H | 0.47 | 0.15 | 0.10 | 0.17 | NA | NA | Yes | No |
| S527I | −1.06 | 0.16 | −0.43 | 0.14 | NA | NA | Yes | No |
| S527L | −0.12 | 0.07 | −0.24 | 0.07 | −0.44 | 0.27 | No | No |
| S527K | −0.09 | 0.11 | −0.57 | 0.13 | NA | NA | Yes | No |
| S527P | 0.07 | 0.10 | −0.33 | 0.11 | −0.47 | 0.36 | Yes | No |
| S527T | 0.01 | 0.09 | −0.30 | 0.10 | −0.22 | 0.18 | Yes | No |
| S527W | 0.03 | 0.07 | 0.15 | 0.07 | −0.50 | 0.23 | Yes | No |
| S527Y | 0.31 | 0.17 | 0.05 | 0.18 | NA | NA | Yes | No |
| S527V | −0.54 | 0.07 | −0.52 | 0.07 | −0.52 | 0.10 | No | No |
| V528D | 0.01 | 0.07 | 0.27 | 0.07 | 0.12 | 0.12 | Yes | Yes |
| V528L | 0.55 | 0.03 | 0.59 | 0.03 | 0.31 | 0.07 | Yes | Yes |
| V528M | 0.19 | 0.05 | 0.02 | 0.05 | 0.13 | 0.10 | Yes | Yes |
| V528A | −0.09 | 0.04 | 0.29 | 0.04 | −0.13 | 0.06 | Yes | No |
| V528R | −0.04 | 0.04 | 0.07 | 0.04 | −0.03 | 0.07 | Yes | No |
| V528N | 0.01 | 0.11 | −0.47 | 0.14 | 0.31 | 0.42 | Yes | No |
| V528C | 0.16 | 0.07 | 0.20 | 0.07 | −0.06 | 0.24 | Yes | No |
| V528Q | −0.44 | 0.09 | −0.29 | 0.09 | 0.07 | 0.11 | Yes | No |
| V528E | −0.66 | 0.06 | 0.16 | 0.05 | 0.00 | 0.11 | Yes | No |
| V528G | −0.14 | 0.02 | −0.19 | 0.02 | −0.19 | 0.03 | No | No |
| V528H | −0.62 | 0.15 | 1.01 | 0.11 | NA | NA | Yes | No |
| V528I | 0.16 | 0.08 | −0.09 | 0.09 | 0.07 | 0.11 | Yes | No |
| V528K | −0.14 | 0.08 | 0.36 | 0.08 | 0.13 | 0.14 | Yes | No |
| V528F | −0.10 | 0.09 | 0.39 | 0.08 | −0.59 | 0.21 | Yes | No |
| V528P | −0.10 | 0.08 | −0.66 | 0.10 | 0.10 | 0.11 | Yes | No |
| V528S | −0.12 | 0.05 | 0.26 | 0.05 | 0.11 | 0.06 | Yes | No |
| V528* | −1.66 | 0.13 | −1.20 | 0.12 | NA | NA | Yes | No |
| V528T | 0.29 | 0.07 | 0.00 | 0.07 | 0.18 | 0.17 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| V528W | −1.31 | 0.07 | −1.47 | 0.08 | −0.99 | 0.14 | No | No |
| V528Y | −0.77 | 0.13 | −0.50 | 0.12 | 0.24 | 0.12 | Yes | No |
| E529A | −0.38 | 0.08 | −0.18 | 0.08 | 0.04 | 0.15 | Yes | No |
| E529R | NA | NA | NA | NA | −0.70 | 0.34 | Yes | No |
| E529D | 0.02 | 0.07 | −0.61 | 0.08 | 0.10 | 0.15 | Yes | No |
| E529Q | −0.43 | 0.14 | −0.49 | 0.15 | NA | NA | Yes | No |
| E529G | −0.25 | 0.05 | −0.16 | 0.05 | −0.61 | 0.11 | No | No |
| E529L | −0.45 | 0.11 | −0.56 | 0.11 | NA | NA | Yes | No |
| E529K | 0.21 | 0.10 | −0.28 | 0.11 | −0.65 | 0.19 | Yes | No |
| E529P | 0.08 | 0.15 | −0.30 | 0.17 | NA | NA | Yes | No |
| E529S | −0.18 | 0.11 | −0.08 | 0.11 | −0.20 | 0.45 | No | No |
| E529* | −0.22 | 0.11 | −0.69 | 0.14 | −0.58 | 0.17 | No | No |
| E529W | −0.19 | 0.13 | −0.11 | 0.13 | NA | NA | Yes | No |
| E529V | −0.35 | 0.06 | 0.08 | 0.06 | −0.48 | 0.10 | Yes | No |
| K530A | −0.96 | 0.10 | −0.76 | 0.10 | −0.90 | 0.14 | No | No |
| K530R | −0.56 | 0.04 | −0.32 | 0.04 | −0.59 | 0.08 | No | No |
| K530N | −0.78 | 0.15 | −0.73 | 0.16 | NA | NA | Yes | No |
| K530C | −0.10 | 0.10 | −0.43 | 0.11 | NA | NA | Yes | No |
| K530Q | −0.22 | 0.05 | −0.56 | 0.05 | −0.60 | 0.10 | No | No |
| K530E | −0.48 | 0.05 | −0.35 | 0.05 | −0.85 | 0.09 | No | No |
| K530G | −1.18 | 0.07 | −1.09 | 0.07 | −1.15 | 0.14 | No | No |
| K530L | −1.74 | 0.09 | −1.04 | 0.07 | −1.40 | 0.14 | No | No |
| K530M | −0.72 | 0.07 | −0.42 | 0.07 | −0.83 | 0.13 | No | No |
| K530F | −1.17 | 0.15 | −0.40 | 0.12 | NA | NA | Yes | No |
| K530S | −1.15 | 0.09 | −0.65 | 0.08 | −1.15 | 0.13 | No | No |
| K530* | −0.63 | 0.07 | −0.43 | 0.07 | −0.68 | 0.09 | No | No |
| K530T | −0.51 | 0.07 | −0.72 | 0.07 | −0.68 | 0.10 | No | No |
| K530W | −1.73 | 0.12 | −0.35 | 0.08 | −1.35 | 0.20 | No | No |
| K530V | −0.98 | 0.08 | −1.46 | 0.10 | −1.55 | 0.23 | No | No |
| F531A | −1.39 | 0.13 | −1.72 | 0.15 | NA | NA | Yes | No |
| F531R | −1.90 | 0.12 | −1.41 | 0.10 | −1.75 | 0.23 | No | No |
| F531C | −0.40 | 0.05 | −0.81 | 0.06 | −0.85 | 0.09 | No | No |
| F531G | −1.68 | 0.08 | −1.22 | 0.07 | −1.58 | 0.14 | No | No |
| F531I | −0.43 | 0.09 | −0.86 | 0.11 | −0.62 | 0.11 | No | No |
| F531L | −0.35 | 0.05 | −0.40 | 0.05 | −0.55 | 0.07 | No | No |
| F531S | −0.56 | 0.07 | −0.79 | 0.08 | −0.98 | 0.11 | No | No |
| F531W | −1.68 | 0.13 | −0.86 | 0.10 | −0.27 | 0.21 | No | No |
| F531Y | −0.99 | 0.16 | −0.55 | 0.14 | NA | NA | Yes | No |
| F531V | −0.22 | 0.02 | −0.64 | 0.03 | −0.74 | 0.05 | No | No |
| K532A | NA | NA | NA | NA | −0.93 | 0.19 | Yes | No |
| K532R | −0.63 | 0.05 | −0.63 | 0.05 | −0.56 | 0.10 | No | No |
| K532N | −0.39 | 0.11 | −0.71 | 0.13 | −0.45 | 0.12 | No | No |
| K532Q | −0.42 | 0.08 | −0.74 | 0.10 | −0.96 | 0.11 | No | No |
| K532E | −0.49 | 0.05 | −0.38 | 0.05 | −0.64 | 0.12 | No | No |
| K532G | −1.74 | 0.08 | −1.15 | 0.07 | −1.35 | 0.11 | No | No |
| K532L | −1.28 | 0.11 | −1.26 | 0.11 | −1.36 | 0.21 | No | No |
| K532M | −0.48 | 0.09 | −0.58 | 0.10 | −0.65 | 0.09 | No | No |
| K532S | NA | NA | NA | NA | −0.93 | 0.25 | Yes | No |
| K532* | −0.42 | 0.06 | −0.27 | 0.06 | −0.65 | 0.12 | No | No |
| K532T | −0.37 | 0.06 | −1.05 | 0.07 | −0.52 | 0.10 | No | No |
| K532V | −1.99 | 0.11 | −1.32 | 0.09 | −1.19 | 0.12 | No | No |
| L533R | −0.17 | 0.04 | −0.41 | 0.04 | −0.57 | 0.08 | No | No |
| L533G | −1.82 | 0.14 | −1.54 | 0.13 | NA | NA | Yes | No |
| L533M | −0.36 | 0.12 | −0.29 | 0.12 | −0.12 | 0.17 | No | No |
| L533P | −0.18 | 0.07 | −0.06 | 0.07 | −0.28 | 0.12 | No | No |
| L533V | −1.49 | 0.12 | −0.64 | 0.09 | −0.58 | 0.19 | No | No |
| N534A | −1.49 | 0.08 | −1.30 | 0.08 | −0.31 | 0.09 | No | No |
| N534R | −1.13 | 0.05 | −1.37 | 0.06 | −0.52 | 0.04 | No | No |
| N534D | −1.07 | 0.08 | −0.72 | 0.07 | −0.75 | 0.11 | No | No |
| N534C | −1.50 | 0.13 | −1.27 | 0.12 | 0.19 | 0.20 | Yes | No |
| N534Q | NA | NA | NA | NA | −0.67 | 0.24 | Yes | No |
| N534E | −2.05 | 0.10 | −1.48 | 0.08 | −1.32 | 0.13 | No | No |
| N534G | −1.43 | 0.04 | −0.96 | 0.04 | −1.10 | 0.04 | No | No |
| N534H | −0.18 | 0.03 | −0.50 | 0.04 | −0.20 | 0.06 | No | No |
| N534I | −0.54 | 0.08 | 0.00 | 0.07 | −0.60 | 0.18 | Yes | No |
| N534L | −1.92 | 0.11 | −1.79 | 0.11 | −0.26 | 0.07 | No | No |
| N534K | −1.00 | 0.07 | −0.74 | 0.07 | −0.01 | 0.10 | No | No |
| N534M | −1.72 | 0.12 | −0.90 | 0.09 | 0.88 | 0.19 | Yes | No |
| N534F | 0.11 | 0.10 | −1.16 | 0.16 | 0.16 | 0.30 | Yes | No |
| N534P | −0.33 | 0.07 | −0.26 | 0.07 | −1.27 | 0.16 | No | No |
| N534S | −1.00 | 0.06 | −0.72 | 0.06 | 0.22 | 0.05 | Yes | No |
| N534* | −1.20 | 0.09 | −2.22 | 0.15 | −1.84 | 0.10 | No | No |
| N534T | −0.38 | 0.04 | −0.40 | 0.04 | 0.49 | 0.06 | Yes | No |
| N534W | −1.54 | 0.08 | −0.69 | 0.06 | −0.29 | 0.07 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| N534Y | −0.97 | 0.12 | −0.47 | 0.10 | −0.57 | 0.17 | No | No |
| N534V | −1.35 | 0.07 | −1.17 | 0.06 | −0.59 | 0.06 | No | No |
| N534A | NA | NA | NA | NA | −0.33 | 0.09 | Yes | No |
| N534R | NA | NA | NA | NA | −0.55 | 0.04 | Yes | No |
| N534D | −0.11 | 0.09 | −0.10 | 0.09 | −0.69 | 0.10 | No | No |
| N534C | NA | NA | NA | NA | 0.16 | 0.19 | Yes | No |
| N534Q | NA | NA | NA | NA | −0.72 | 0.24 | Yes | No |
| N534E | NA | NA | NA | NA | −1.34 | 0.13 | Yes | No |
| N534G | NA | NA | NA | NA | −1.11 | 0.04 | Yes | No |
| N534H | NA | NA | NA | NA | −0.19 | 0.24 | Yes | No |
| N534I | −0.14 | 0.19 | −0.05 | 0.19 | −0.61 | 0.19 | No | No |
| N534L | NA | NA | NA | NA | −0.22 | 0.07 | Yes | No |
| N534K | −0.47 | 0.14 | −0.26 | 0.13 | −0.06 | 0.09 | No | No |
| N534M | NA | NA | NA | NA | 0.83 | 0.18 | Yes | No |
| N534F | NA | NA | NA | NA | 0.26 | 0.30 | Yes | No |
| N534S | −0.15 | 0.07 | −0.03 | 0.07 | 0.20 | 0.05 | Yes | No |
| N534* | NA | NA | NA | NA | −1.73 | 0.10 | Yes | No |
| N534T | NA | NA | NA | NA | 0.91 | 0.15 | Yes | No |
| N534W | NA | NA | NA | NA | −0.32 | 0.07 | Yes | No |
| N534Y | −0.01 | 0.13 | 0.04 | 0.13 | −0.53 | 0.16 | Yes | No |
| N534V | NA | NA | NA | NA | −0.57 | 0.06 | Yes | No |
| F535A | −1.29 | 0.08 | −1.38 | 0.09 | −1.53 | 0.15 | No | No |
| F535R | −2.11 | 0.10 | −1.42 | 0.08 | −1.73 | 0.13 | No | No |
| F535C | −0.48 | 0.06 | −0.52 | 0.06 | −0.79 | 0.05 | No | No |
| F535E | −2.40 | 0.14 | −1.29 | 0.09 | −1.54 | 0.09 | No | No |
| F535G | −1.68 | 0.06 | −1.41 | 0.05 | −1.60 | 0.04 | No | No |
| F535I | −0.99 | 0.13 | −0.63 | 0.12 | NA | NA | Yes | No |
| F535L | −0.97 | 0.06 | −0.52 | 0.05 | −0.92 | 0.05 | No | No |
| F535M | −0.78 | 0.11 | −0.99 | 0.13 | −0.68 | 0.24 | No | No |
| F535S | −0.91 | 0.06 | −0.54 | 0.06 | −1.11 | 0.09 | No | No |
| F535W | −2.13 | 0.11 | −1.41 | 0.09 | −1.73 | 0.15 | No | No |
| F535Y | −0.65 | 0.10 | −0.50 | 0.10 | −0.62 | 0.16 | No | No |
| F535V | −0.87 | 0.04 | −1.00 | 0.05 | −0.98 | 0.04 | No | No |
| F535A | NA | NA | NA | NA | −1.47 | 0.15 | Yes | No |
| F535R | NA | NA | NA | NA | −1.74 | 0.12 | Yes | No |
| F535C | −0.09 | 0.06 | 0.09 | 0.05 | −0.54 | 0.06 | Yes | No |
| F535E | NA | NA | NA | NA | −1.65 | 0.09 | Yes | No |
| F535G | NA | NA | NA | NA | −1.93 | 0.04 | Yes | No |
| F535L | −0.04 | 0.06 | 0.03 | 0.06 | −0.69 | 0.05 | Yes | No |
| F535M | NA | NA | NA | NA | −0.67 | 0.21 | Yes | No |
| F535S | −0.14 | 0.08 | 0.00 | 0.08 | −1.14 | 0.09 | No | No |
| F535W | NA | NA | NA | NA | −1.68 | 0.14 | Yes | No |
| F535Y | −0.19 | 0.12 | −0.06 | 0.12 | −0.53 | 0.17 | No | No |
| F535V | −0.05 | 0.05 | −0.01 | 0.05 | −0.76 | 0.06 | No | No |
| Q536A | NA | NA | NA | NA | −0.02 | 0.19 | Yes | No |
| Q536R | 0.02 | 0.08 | −0.02 | 0.09 | 0.08 | 0.05 | Yes | No |
| Q536D | NA | NA | NA | NA | 0.23 | 0.28 | Yes | No |
| Q536C | NA | NA | NA | NA | −1.02 | 0.28 | Yes | No |
| Q536E | 0.00 | 0.16 | 0.02 | 0.16 | −0.66 | 0.08 | Yes | No |
| Q536G | NA | NA | NA | NA | 1.22 | 0.05 | Yes | No |
| Q536H | −0.05 | 0.19 | −0.05 | 0.19 | −0.34 | 0.22 | No | No |
| Q536L | −0.10 | 0.15 | −0.11 | 0.15 | −1.09 | 0.14 | No | No |
| Q536K | 0.56 | 0.09 | −0.36 | 0.11 | −0.09 | 0.13 | Yes | No |
| Q536S | NA | NA | NA | NA | 0.60 | 0.09 | Yes | No |
| Q536* | 0.15 | 0.09 | 0.03 | 0.10 | −0.74 | 0.10 | Yes | No |
| Q536V | NA | NA | NA | NA | −1.88 | 0.09 | Yes | No |
| R537A | −1.11 | 0.10 | −1.99 | 0.15 | NA | NA | Yes | No |
| R537Q | −0.56 | 0.13 | −1.08 | 0.16 | NA | NA | Yes | No |
| R537E | −1.40 | 0.13 | −1.33 | 0.13 | NA | NA | Yes | No |
| R537G | −1.10 | 0.05 | −1.07 | 0.05 | NA | NA | Yes | No |
| R537L | −1.50 | 0.13 | −1.38 | 0.12 | NA | NA | Yes | No |
| R537K | −0.58 | 0.09 | −0.81 | 0.10 | NA | NA | Yes | No |
| R537M | −1.57 | 0.02 | −1.19 | 0.02 | NA | NA | Yes | No |
| R537S | −1.30 | 0.11 | −0.65 | 0.08 | NA | NA | Yes | No |
| R537W | −1.42 | 0.10 | −1.60 | 0.11 | NA | NA | Yes | No |
| R537V | −1.52 | 0.11 | −1.85 | 0.12 | NA | NA | Yes | No |
| M537A | NA | NA | NA | NA | −1.52 | 0.24 | Yes | No |
| M537R | NA | NA | NA | NA | 1.70 | 0.04 | Yes | No |
| M537G | NA | NA | NA | NA | −1.55 | 0.08 | Yes | No |
| M537I | NA | NA | NA | NA | −0.01 | 0.15 | Yes | No |
| M537L | NA | NA | NA | NA | −0.09 | 0.13 | Yes | No |
| M537K | NA | NA | NA | NA | 0.19 | 0.14 | Yes | No |
| M537T | NA | NA | NA | NA | −0.29 | 0.13 | Yes | No |
| M537W | NA | NA | NA | NA | −1.30 | 0.19 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| M537V | NA | NA | NA | NA | −0.62 | 0.10 | Yes | No |
| P538A | NA | NA | NA | NA | −1.19 | 0.06 | Yes | No |
| P538R | NA | NA | NA | NA | −1.72 | 0.08 | Yes | No |
| P538Q | NA | NA | NA | NA | −1.46 | 0.11 | Yes | No |
| P538E | NA | NA | NA | NA | −1.79 | 0.22 | Yes | No |
| P538G | NA | NA | NA | NA | −1.67 | 0.09 | Yes | No |
| P538H | −0.20 | 0.17 | −0.19 | 0.17 | NA | NA | Yes | No |
| P538L | −0.23 | 0.12 | −0.09 | 0.11 | −1.49 | 0.05 | No | No |
| P538S | 0.19 | 0.12 | 0.18 | 0.12 | −1.47 | 0.11 | Yes | No |
| P538T | −0.08 | 0.06 | 0.13 | 0.06 | −0.38 | 0.06 | Yes | No |
| P538W | NA | NA | NA | NA | −1.82 | 0.17 | Yes | No |
| P538V | NA | NA | NA | NA | −0.71 | 0.14 | Yes | No |
| T539A | 0.08 | 0.07 | −0.03 | 0.08 | −1.10 | 0.06 | Yes | No |
| T539R | NA | NA | NA | NA | −1.51 | 0.10 | Yes | No |
| T539N | 0.16 | 0.14 | 0.06 | 0.15 | −1.00 | 0.17 | Yes | No |
| T539C | NA | NA | NA | NA | −1.11 | 0.14 | Yes | No |
| T539Q | NA | NA | NA | NA | −1.19 | 0.20 | Yes | No |
| T539E | NA | NA | NA | NA | −1.61 | 0.12 | Yes | No |
| T539G | NA | NA | NA | NA | −1.63 | 0.05 | Yes | No |
| T539I | −0.20 | 0.13 | 0.00 | 0.13 | −1.04 | 0.16 | No | No |
| T539L | NA | NA | NA | NA | −2.07 | 0.13 | Yes | No |
| T539K | NA | NA | NA | NA | −1.23 | 0.26 | Yes | No |
| T539M | NA | NA | NA | NA | −1.64 | 0.18 | Yes | No |
| T539P | −0.33 | 0.14 | −0.40 | 0.14 | −1.51 | 0.14 | No | No |
| T539S | −0.03 | 0.05 | −0.17 | 0.05 | −0.14 | 0.04 | No | No |
| T539V | NA | NA | NA | NA | −1.65 | 0.11 | Yes | No |
| L540R | −0.17 | 0.15 | −0.30 | 0.15 | −1.27 | 0.14 | No | No |
| L540Q | 0.12 | 0.08 | 0.13 | 0.08 | −0.05 | 0.08 | Yes | No |
| L540G | NA | NA | NA | NA | −1.83 | 0.13 | Yes | No |
| L540M | 0.04 | 0.08 | −0.02 | 0.09 | −0.13 | 0.07 | Yes | No |
| L540P | 0.05 | 0.09 | 0.09 | 0.09 | −0.40 | 0.13 | Yes | No |
| L540V | NA | NA | NA | NA | −1.58 | 0.24 | Yes | No |
| A541R | NA | NA | NA | NA | −1.71 | 0.09 | Yes | No |
| A541D | 0.11 | 0.12 | 0.35 | 0.11 | −0.22 | 0.06 | Yes | No |
| A541C | NA | NA | NA | NA | 0.02 | 0.39 | Yes | No |
| A541G | 0.38 | 0.07 | 0.36 | 0.07 | −0.06 | 0.12 | Yes | No |
| A541L | NA | NA | NA | NA | 0.32 | 0.23 | Yes | No |
| A541S | −0.11 | 0.15 | −0.14 | 0.15 | −1.66 | 0.14 | No | No |
| A541T | −0.11 | 0.05 | −0.11 | 0.05 | −0.50 | 0.12 | No | No |
| A541V | −0.06 | 0.09 | 0.00 | 0.09 | −0.77 | 0.12 | No | No |
| S542N | 0.24 | 0.09 | 0.02 | 0.09 | 0.29 | 0.07 | Yes | Yes |
| S542C | 0.03 | 0.17 | 0.15 | 0.17 | 0.42 | 0.16 | Yes | Yes |
| S542A | NA | NA | NA | NA | 0.79 | 0.05 | Yes | No |
| S542R | −0.37 | 0.10 | −0.13 | 0.10 | 1.34 | 0.04 | Yes | No |
| S542D | NA | NA | NA | NA | −0.70 | 0.14 | Yes | No |
| S542Q | NA | NA | NA | NA | 0.04 | 0.23 | Yes | No |
| S542E | NA | NA | NA | NA | −1.68 | 0.07 | Yes | No |
| S542G | 0.23 | 0.07 | −0.10 | 0.08 | −0.79 | 0.06 | Yes | No |
| S542H | NA | NA | NA | NA | 0.08 | 0.35 | Yes | No |
| S542I | NA | NA | NA | NA | −0.13 | 0.32 | Yes | No |
| S542L | NA | NA | NA | NA | 0.67 | 0.10 | Yes | No |
| S542K | NA | NA | NA | NA | 1.36 | 0.09 | Yes | No |
| S542M | NA | NA | NA | NA | 1.10 | 0.11 | Yes | No |
| S542P | NA | NA | NA | NA | −0.85 | 0.27 | Yes | No |
| S542T | 0.68 | 0.17 | 0.24 | 0.19 | −0.08 | 0.10 | Yes | No |
| S542W | NA | NA | NA | NA | −0.34 | 0.06 | Yes | No |
| S542V | NA | NA | NA | NA | 0.38 | 0.08 | Yes | No |
| G543A | −2.33 | 0.07 | −1.64 | 0.05 | −2.12 | 0.10 | No | No |
| G543R | −1.78 | 0.05 | −1.75 | 0.05 | −1.89 | 0.07 | No | No |
| G543D | −1.02 | 0.07 | −1.88 | 0.09 | NA | NA | Yes | No |
| G543C | −0.32 | 0.04 | −0.29 | 0.04 | −0.07 | 0.06 | No | No |
| G543E | −2.56 | 0.11 | −1.80 | 0.08 | −2.09 | 0.18 | No | No |
| G543I | −1.30 | 0.14 | −1.24 | 0.13 | NA | NA | Yes | No |
| G543L | −1.74 | 0.08 | −1.17 | 0.06 | −1.85 | 0.22 | No | No |
| G543F | −0.91 | 0.09 | −0.77 | 0.08 | −0.93 | 0.14 | No | No |
| G543P | −1.28 | 0.08 | −1.18 | 0.08 | −1.40 | 0.22 | No | No |
| G543S | −1.21 | 0.05 | −1.22 | 0.05 | −1.63 | 0.08 | No | No |
| G543* | −1.66 | 0.13 | −1.93 | 0.14 | NA | NA | Yes | No |
| G543W | −1.55 | 0.08 | −1.49 | 0.07 | NA | NA | Yes | No |
| G543V | −0.80 | 0.03 | −0.81 | 0.03 | −0.80 | 0.06 | No | No |
| W544A | −1.17 | 0.05 | −1.90 | 0.06 | −1.67 | 0.09 | No | No |
| W544R | −1.30 | 0.03 | −1.40 | 0.03 | −1.35 | 0.04 | No | No |
| W544N | −1.11 | 0.10 | −1.78 | 0.13 | NA | NA | Yes | No |
| W544D | −1.61 | 0.09 | −1.58 | 0.09 | −1.51 | 0.14 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| W544C | −0.88 | 0.06 | −1.34 | 0.07 | −1.21 | 0.10 | No | No |
| W544Q | −1.24 | 0.08 | −1.17 | 0.08 | NA | NA | Yes | No |
| W544E | −1.14 | 0.05 | −1.44 | 0.05 | −1.54 | 0.06 | No | No |
| W544G | −1.68 | 0.03 | −1.47 | 0.03 | −1.55 | 0.04 | No | No |
| W544H | −0.01 | 0.08 | −1.46 | 0.13 | NA | NA | Yes | No |
| W544L | −1.76 | 0.06 | −1.40 | 0.05 | −1.41 | 0.04 | No | No |
| W544K | −2.26 | 0.11 | −1.33 | 0.07 | −1.39 | 0.08 | No | No |
| W544M | −2.09 | 0.11 | −1.42 | 0.08 | −1.45 | 0.15 | No | No |
| W544F | −0.96 | 0.09 | −1.72 | 0.12 | NA | NA | Yes | No |
| W544P | −1.84 | 0.09 | −1.34 | 0.08 | −1.51 | 0.09 | No | No |
| W544S | −0.66 | 0.03 | −0.59 | 0.03 | −0.57 | 0.03 | No | No |
| W544* | −0.85 | 0.05 | −1.05 | 0.05 | −1.09 | 0.07 | No | No |
| W544T | −1.81 | 0.09 | −1.08 | 0.07 | −1.83 | 0.17 | No | No |
| W544V | −1.60 | 0.05 | −1.52 | 0.05 | −1.52 | 0.09 | No | No |
| D545A | −1.34 | 0.06 | −1.18 | 0.06 | −1.75 | 0.13 | No | No |
| D545R | −2.22 | 0.08 | −1.82 | 0.06 | −1.53 | 0.12 | No | No |
| D545N | −1.00 | 0.10 | −0.89 | 0.09 | −1.05 | 0.15 | No | No |
| D545C | −2.14 | 0.13 | −1.41 | 0.10 | NA | NA | Yes | No |
| D545E | −1.54 | 0.07 | −2.07 | 0.09 | −1.66 | 0.14 | No | No |
| D545G | −1.30 | 0.04 | −1.13 | 0.04 | −1.44 | 0.07 | No | No |
| D545H | −1.20 | 0.14 | −0.72 | 0.12 | NA | NA | Yes | No |
| D545L | −1.77 | 0.08 | −1.23 | 0.06 | −1.75 | 0.21 | No | No |
| D545K | −1.83 | 0.15 | −1.54 | 0.14 | NA | NA | Yes | No |
| D545M | −1.30 | 0.11 | −0.90 | 0.10 | NA | NA | Yes | No |
| D545P | −1.73 | 0.12 | −1.07 | 0.09 | NA | NA | Yes | No |
| D545S | −0.99 | 0.06 | −0.97 | 0.06 | −1.65 | 0.18 | No | No |
| D545T | −2.02 | 0.14 | −1.36 | 0.10 | −1.24 | 0.25 | No | No |
| D545W | −2.52 | 0.12 | −2.44 | 0.12 | −1.79 | 0.16 | No | No |
| D545Y | −1.34 | 0.12 | −1.40 | 0.12 | NA | NA | Yes | No |
| D545V | −1.90 | 0.07 | −1.31 | 0.05 | −1.58 | 0.10 | No | No |
| V546A | 0.05 | 0.04 | −0.28 | 0.04 | −1.03 | 0.08 | Yes | No |
| V546R | −0.34 | 0.04 | −0.10 | 0.04 | −0.24 | 0.05 | No | No |
| V546D | −1.89 | 0.14 | −0.98 | 0.10 | −1.80 | 0.23 | No | No |
| V546C | −0.63 | 0.08 | 0.12 | 0.06 | −1.17 | 0.18 | Yes | No |
| V546Q | −0.14 | 0.09 | −0.04 | 0.08 | −0.37 | 0.22 | No | No |
| V546E | −0.85 | 0.06 | −0.72 | 0.06 | −1.16 | 0.10 | No | No |
| V546G | −0.89 | 0.03 | −0.75 | 0.03 | −1.38 | 0.06 | No | No |
| V546I | 0.17 | 0.09 | −0.21 | 0.10 | −0.01 | 0.36 | Yes | No |
| V546L | −0.09 | 0.04 | −0.03 | 0.04 | −0.77 | 0.12 | No | No |
| V546K | −0.23 | 0.09 | −0.07 | 0.09 | −0.28 | 0.09 | No | No |
| V546M | −0.48 | 0.06 | −0.39 | 0.06 | −0.14 | 0.11 | No | No |
| V546F | −0.58 | 0.10 | −1.20 | 0.13 | NA | NA | Yes | No |
| V546S | −0.24 | 0.05 | −0.75 | 0.06 | −1.19 | 0.07 | No | No |
| V546* | −1.55 | 0.12 | −1.19 | 0.10 | −1.56 | 0.23 | No | No |
| V546T | 0.15 | 0.07 | −0.59 | 0.09 | −0.82 | 0.09 | Yes | No |
| V546W | −1.75 | 0.08 | −1.06 | 0.06 | −1.43 | 0.15 | No | No |
| V546Y | 0.40 | 0.10 | −0.50 | 0.13 | −0.45 | 0.39 | Yes | No |
| N547A | −0.97 | 0.06 | −0.81 | 0.06 | −1.74 | 0.12 | No | No |
| N547R | −0.75 | 0.04 | −0.98 | 0.05 | −1.25 | 0.05 | No | No |
| N547D | −1.06 | 0.08 | −0.98 | 0.08 | −1.08 | 0.12 | No | No |
| N547E | −1.13 | 0.07 | −1.64 | 0.09 | NA | NA | Yes | No |
| N547E | −0.99 | 0.04 | −1.38 | 0.05 | −1.68 | 0.04 | No | No |
| N547I | −0.57 | 0.10 | −0.69 | 0.10 | −0.97 | 0.15 | No | No |
| N547L | −2.14 | 0.12 | −1.01 | 0.07 | −1.56 | 0.18 | No | No |
| N547K | −0.72 | 0.08 | −0.48 | 0.07 | −0.83 | 0.12 | No | No |
| N547S | −0.69 | 0.06 | −0.98 | 0.06 | −1.07 | 0.09 | No | No |
| N547T | −2.13 | 0.13 | −1.62 | 0.11 | NA | NA | Yes | No |
| N547W | −1.69 | 0.09 | −1.84 | 0.10 | NA | NA | Yes | No |
| N547Y | −0.39 | 0.10 | −0.94 | 0.12 | −1.04 | 0.21 | No | No |
| N547V | −1.63 | 0.07 | −1.46 | 0.07 | −1.86 | 0.15 | No | No |
| K548A | −1.24 | 0.04 | −1.12 | 0.04 | −1.74 | 0.03 | No | No |
| K548R | −0.59 | 0.02 | −0.51 | 0.02 | −0.18 | 0.03 | No | No |
| K548N | −0.98 | 0.07 | −1.11 | 0.08 | −1.10 | 0.09 | No | No |
| K548D | −2.69 | 0.13 | −1.63 | 0.08 | −2.01 | 0.14 | No | No |
| K548C | −0.97 | 0.06 | −0.64 | 0.05 | −1.44 | 0.14 | No | No |
| K548Q | −0.31 | 0.04 | −0.24 | 0.04 | −0.41 | 0.06 | No | No |
| K548E | −1.54 | 0.05 | −1.45 | 0.05 | −1.51 | 0.04 | No | No |
| K548G | −1.14 | 0.02 | −0.95 | 0.02 | −1.61 | 0.02 | No | No |
| K548H | −1.58 | 0.14 | −1.58 | 0.14 | NA | NA | Yes | No |
| K548I | −1.05 | 0.07 | −1.27 | 0.08 | −0.98 | 0.06 | No | No |
| K548L | −1.72 | 0.06 | −1.56 | 0.05 | −1.96 | 0.08 | No | No |
| K548M | −0.27 | 0.04 | −0.19 | 0.04 | −1.10 | 0.10 | No | No |
| K548F | −2.01 | 0.12 | −1.60 | 0.10 | NA | NA | Yes | No |
| K548P | −1.78 | 0.09 | −1.04 | 0.07 | −1.86 | 0.16 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| K548S | −0.97 | 0.04 | −0.55 | 0.03 | −1.40 | 0.08 | No | No |
| K548* | −1.65 | 0.08 | −0.85 | 0.06 | −1.40 | 0.13 | No | No |
| K548T | −0.12 | 0.04 | −0.74 | 0.05 | −1.19 | 0.07 | No | No |
| K548W | −2.13 | 0.07 | −1.65 | 0.05 | −1.44 | 0.07 | No | No |
| K548Y | −1.07 | 0.09 | −1.63 | 0.11 | NA | NA | Yes | No |
| K548V | −0.72 | 0.03 | −0.39 | 0.03 | −0.97 | 0.05 | No | No |
| E549A | −1.80 | 0.06 | −1.49 | 0.05 | −1.69 | 0.07 | No | No |
| E549R | −1.64 | 0.05 | −1.69 | 0.05 | −1.80 | 0.09 | No | No |
| E549D | −1.63 | 0.09 | −1.13 | 0.07 | −1.53 | 0.14 | No | No |
| E549C | −2.08 | 0.12 | −1.84 | 0.11 | −1.56 | 0.18 | No | No |
| E549Q | −0.41 | 0.05 | −0.41 | 0.05 | −0.80 | 0.10 | No | No |
| E549G | −1.50 | 0.03 | −1.53 | 0.03 | −1.60 | 0.04 | No | No |
| E549I | −1.07 | 0.12 | −1.12 | 0.13 | NA | NA | Yes | No |
| E549L | −1.62 | 0.07 | −1.31 | 0.06 | −1.65 | 0.13 | No | No |
| E549K | −0.91 | 0.07 | −0.89 | 0.07 | −0.99 | 0.08 | No | No |
| E549M | −2.06 | 0.12 | −1.66 | 0.10 | −1.57 | 0.17 | No | No |
| E549F | −1.59 | 0.14 | −1.27 | 0.13 | NA | NA | Yes | No |
| E549S | −2.21 | 0.08 | −1.69 | 0.07 | −1.91 | 0.05 | No | No |
| E549* | −1.66 | 0.09 | −1.47 | 0.09 | −1.59 | 0.14 | No | No |
| E549T | NA | NA | NA | NA | −1.39 | 0.10 | Yes | No |
| E549W | −0.99 | 0.05 | −1.72 | 0.07 | −1.85 | 0.11 | No | No |
| E549V | −1.01 | 0.04 | −0.79 | 0.04 | −1.37 | 0.04 | No | No |
| K550R | 0.05 | 0.03 | 0.18 | 0.03 | 0.17 | 0.07 | Yes | Yes |
| K550A | −0.24 | 0.04 | −0.06 | 0.04 | −0.91 | 0.13 | No | No |
| K550N | 0.11 | 0.07 | −0.13 | 0.07 | −0.46 | 0.13 | Yes | No |
| K550D | −0.86 | 0.09 | 0.22 | 0.07 | −1.48 | 0.23 | Yes | No |
| K550C | −0.08 | 0.07 | −0.18 | 0.07 | −0.84 | 0.21 | No | No |
| K550Q | −0.18 | 0.07 | 0.45 | 0.07 | −0.64 | 0.18 | Yes | No |
| K550E | −0.86 | 0.06 | −0.45 | 0.05 | −1.11 | 0.09 | No | No |
| K550G | −0.25 | 0.02 | −0.16 | 0.02 | −1.14 | 0.04 | No | No |
| K550H | −0.22 | 0.15 | −0.42 | 0.16 | NA | NA | Yes | No |
| K550I | −0.51 | 0.12 | 0.79 | 0.09 | NA | NA | Yes | No |
| K550L | 0.01 | 0.05 | −0.17 | 0.05 | −0.95 | 0.06 | Yes | No |
| K550M | −0.71 | 0.08 | −0.17 | 0.07 | −0.72 | 0.15 | No | No |
| K550F | −0.14 | 0.10 | −0.39 | 0.11 | NA | NA | Yes | No |
| K550P | −0.02 | 0.08 | −0.78 | 0.10 | −0.95 | 0.27 | No | No |
| K550S | −0.07 | 0.05 | −0.22 | 0.05 | −1.05 | 0.08 | No | No |
| K550* | −0.98 | 0.08 | −1.14 | 0.09 | −1.19 | 0.10 | No | No |
| K550T | −0.13 | 0.06 | −0.44 | 0.07 | −0.87 | 0.14 | No | No |
| K550W | 0.18 | 0.04 | 0.20 | 0.04 | −0.66 | 0.07 | Yes | No |
| K550Y | −0.12 | 0.11 | −0.58 | 0.12 | NA | NA | Yes | No |
| K550V | −0.12 | 0.04 | −0.70 | 0.05 | −1.02 | 0.13 | No | No |
| N551D | 0.14 | 0.04 | 0.15 | 0.04 | 0.67 | 0.07 | Yes | Yes |
| N551A | −0.29 | 0.04 | −0.42 | 0.04 | −0.37 | 0.05 | No | No |
| N551R | −0.92 | 0.04 | −1.40 | 0.05 | −1.64 | 0.09 | No | No |
| N551C | −0.52 | 0.08 | −0.26 | 0.08 | −0.39 | 0.28 | No | No |
| N551Q | −0.77 | 0.09 | −0.58 | 0.08 | −0.76 | 0.10 | No | No |
| N551E | −1.32 | 0.06 | −0.66 | 0.05 | −1.51 | 0.10 | No | No |
| N551G | −0.95 | 0.03 | −0.96 | 0.03 | −1.10 | 0.04 | No | No |
| N551H | 0.51 | 0.09 | −1.02 | 0.14 | 0.55 | 0.13 | Yes | No |
| N551I | −0.01 | 0.05 | 0.20 | 0.05 | −0.18 | 0.11 | Yes | No |
| N551L | −0.07 | 0.05 | −0.83 | 0.06 | −1.35 | 0.11 | No | No |
| N551K | −1.43 | 0.07 | −1.28 | 0.07 | −1.22 | 0.08 | No | No |
| N551M | −1.01 | 0.09 | −0.58 | 0.08 | −0.94 | 0.18 | No | No |
| N551F | −0.65 | 0.11 | −0.19 | 0.09 | −0.04 | 0.24 | No | No |
| N551P | −1.24 | 0.10 | −0.91 | 0.09 | −1.21 | 0.12 | No | No |
| N551S | −0.06 | 0.03 | 0.02 | 0.03 | −0.23 | 0.05 | Yes | No |
| N551* | −1.09 | 0.10 | −1.44 | 0.11 | −1.45 | 0.20 | No | No |
| N551T | 0.21 | 0.05 | −0.29 | 0.06 | 0.07 | 0.11 | Yes | No |
| N551W | −0.36 | 0.06 | −0.69 | 0.06 | −0.63 | 0.13 | No | No |
| N551Y | −0.28 | 0.07 | 0.04 | 0.06 | 0.95 | 0.10 | Yes | No |
| N551V | −0.31 | 0.04 | −0.21 | 0.04 | 0.03 | 0.05 | Yes | No |
| N552A | −1.33 | 0.07 | −1.21 | 0.07 | −1.32 | 0.08 | No | No |
| N552R | −1.19 | 0.04 | −1.37 | 0.05 | −1.47 | 0.04 | No | No |
| N552D | −1.18 | 0.07 | −1.04 | 0.06 | −1.24 | 0.06 | No | No |
| N552C | −1.59 | 0.10 | −1.44 | 0.09 | −1.65 | 0.17 | No | No |
| N552Q | −1.21 | 0.11 | −0.81 | 0.10 | NA | NA | Yes | No |
| N552E | −1.93 | 0.09 | −0.57 | 0.05 | −1.89 | 0.06 | No | No |
| N552G | −1.80 | 0.05 | −1.17 | 0.04 | −2.06 | 0.03 | No | No |
| N552H | −0.25 | 0.10 | −0.21 | 0.10 | NA | NA | Yes | No |
| N552I | −0.34 | 0.05 | −0.02 | 0.05 | −0.50 | 0.09 | No | No |
| N552L | −1.13 | 0.07 | −1.91 | 0.10 | −1.73 | 0.12 | No | No |
| N552K | −1.34 | 0.08 | −1.25 | 0.08 | −1.07 | 0.10 | No | No |
| N552M | −1.92 | 0.12 | −1.44 | 0.10 | −1.67 | 0.11 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| N552P | −1.69 | 0.12 | −0.81 | 0.09 | NA | NA | Yes | No |
| N552S | −0.11 | 0.03 | −0.20 | 0.03 | −0.58 | 0.05 | No | No |
| N552* | NA | NA | NA | NA | −1.37 | 0.20 | Yes | No |
| N552T | −0.16 | 0.03 | 0.00 | 0.03 | −1.04 | 0.10 | No | No |
| N552W | −1.97 | 0.10 | −1.69 | 0.08 | −1.53 | 0.15 | No | No |
| N552Y | −0.89 | 0.10 | −0.99 | 0.10 | −1.08 | 0.18 | No | No |
| N552V | −1.60 | 0.07 | −1.17 | 0.06 | −1.56 | 0.05 | No | No |
| G553A | −0.56 | 0.05 | −0.61 | 0.05 | −1.53 | 0.11 | No | No |
| G553R | −1.58 | 0.06 | −1.17 | 0.05 | −0.39 | 0.07 | No | No |
| G553D | −0.48 | 0.08 | −0.91 | 0.09 | −0.94 | 0.19 | No | No |
| G553Q | −1.38 | 0.15 | −1.10 | 0.14 | NA | NA | Yes | No |
| G553E | −2.07 | 0.11 | −1.79 | 0.10 | −1.67 | 0.17 | No | No |
| G553S | −0.78 | 0.06 | −0.54 | 0.06 | −0.72 | 0.09 | No | No |
| G553* | −1.04 | 0.12 | −1.39 | 0.14 | NA | NA | Yes | No |
| G553W | −1.11 | 0.07 | −1.87 | 0.09 | −1.59 | 0.16 | No | No |
| G553V | −0.34 | 0.03 | −0.24 | 0.03 | −0.30 | 0.05 | No | No |
| A554I | 0.15 | 0.09 | 0.71 | 0.08 | 0.39 | 0.34 | Yes | Yes |
| A554T | 0.45 | 0.04 | 0.32 | 0.05 | 0.93 | 0.07 | Yes | Yes |
| A554V | 0.57 | 0.03 | 0.48 | 0.03 | 0.54 | 0.04 | Yes | Yes |
| A554R | −1.28 | 0.05 | −1.12 | 0.05 | −2.05 | 0.11 | No | No |
| A554N | 0.04 | 0.09 | −0.71 | 0.11 | −0.12 | 0.13 | Yes | No |
| A554D | −1.96 | 0.10 | −0.95 | 0.07 | −0.83 | 0.04 | No | No |
| A554C | −0.05 | 0.07 | 0.32 | 0.06 | 1.05 | 0.09 | Yes | No |
| A554Q | −0.47 | 0.10 | −0.57 | 0.10 | −1.06 | 0.28 | No | No |
| A554E | −1.85 | 0.09 | −0.79 | 0.06 | −1.86 | 0.11 | No | No |
| A554G | −0.43 | 0.03 | −0.54 | 0.03 | −0.70 | 0.04 | No | No |
| A554L | −0.23 | 0.05 | −0.11 | 0.05 | −0.32 | 0.17 | No | No |
| A554M | 0.27 | 0.07 | −0.26 | 0.08 | −0.72 | 0.23 | Yes | No |
| A554P | −1.28 | 0.09 | −1.84 | 0.12 | NA | NA | Yes | No |
| A554S | 0.14 | 0.03 | 0.15 | 0.03 | −0.07 | 0.05 | Yes | No |
| A554* | −1.77 | 0.14 | −1.03 | 0.11 | NA | NA | Yes | No |
| A554W | −1.54 | 0.09 | −2.63 | 0.14 | NA | NA | Yes | No |
| I555V | 0.41 | 0.03 | 0.13 | 0.03 | 0.14 | 0.06 | Yes | Yes |
| I555A | −0.39 | 0.05 | −0.48 | 0.05 | −0.79 | 0.14 | No | No |
| I555R | −0.47 | 0.04 | −1.21 | 0.05 | −0.58 | 0.09 | No | No |
| I555N | −0.51 | 0.08 | −0.76 | 0.08 | −0.76 | 0.13 | No | No |
| I555D | −1.00 | 0.09 | −1.17 | 0.10 | NA | NA | Yes | No |
| I555C | −1.00 | 0.12 | −0.93 | 0.12 | −0.75 | 0.10 | No | No |
| I555Q | −0.79 | 0.11 | −0.92 | 0.11 | −0.84 | 0.21 | No | No |
| I555E | −2.31 | 0.12 | −0.09 | 0.05 | −1.79 | 0.15 | No | No |
| I555G | −1.15 | 0.04 | −1.07 | 0.04 | −1.57 | 0.03 | No | No |
| I555L | 0.18 | 0.05 | −0.03 | 0.05 | −0.30 | 0.14 | Yes | No |
| I555K | −0.71 | 0.09 | −0.03 | 0.07 | −1.33 | 0.11 | No | No |
| I555M | −0.04 | 0.05 | −0.01 | 0.05 | −0.27 | 0.08 | No | No |
| I555F | −0.18 | 0.09 | −0.17 | 0.09 | −0.32 | 0.13 | No | No |
| I555P | −1.29 | 0.11 | −1.66 | 0.13 | −1.11 | 0.36 | No | No |
| I555S | −0.16 | 0.03 | −0.12 | 0.03 | −0.31 | 0.05 | No | No |
| I555T | −0.01 | 0.05 | −0.09 | 0.05 | −0.45 | 0.11 | No | No |
| I555W | −1.78 | 0.11 | −1.29 | 0.09 | −1.81 | 0.15 | No | No |
| I555Y | −1.05 | 0.14 | −1.16 | 0.15 | NA | NA | Yes | No |
| L556M | 0.08 | 0.08 | 0.10 | 0.08 | 0.11 | 0.21 | Yes | Yes |
| L556A | −0.52 | 0.07 | −1.77 | 0.12 | −1.33 | 0.24 | No | No |
| L556R | −1.06 | 0.06 | −0.91 | 0.06 | −1.39 | 0.10 | No | No |
| L556C | −1.31 | 0.13 | −0.58 | 0.10 | NA | NA | Yes | No |
| L556Q | −0.06 | 0.06 | −0.34 | 0.07 | −0.36 | 0.11 | No | No |
| L556G | −1.55 | 0.07 | −1.49 | 0.07 | −1.60 | 0.06 | No | No |
| L556I | 0.58 | 0.12 | 0.07 | 0.14 | NA | NA | Yes | No |
| L556P | −0.19 | 0.07 | −0.54 | 0.08 | −0.91 | 0.13 | No | No |
| L556S | −1.56 | 0.11 | −1.28 | 0.10 | NA | NA | Yes | No |
| L556T | −0.95 | 0.12 | −0.69 | 0.11 | NA | NA | Yes | No |
| L556W | −1.77 | 0.12 | −1.41 | 0.11 | NA | NA | Yes | No |
| L556V | −0.45 | 0.06 | −0.17 | 0.05 | −0.76 | 0.14 | No | No |
| F557A | −0.39 | 0.05 | −0.06 | 0.05 | −0.75 | 0.07 | No | No |
| F557R | −1.79 | 0.06 | −1.05 | 0.05 | −1.57 | 0.08 | No | No |
| F557N | NA | NA | NA | NA | −0.90 | 0.11 | Yes | No |
| F557C | −0.63 | 0.06 | −0.55 | 0.06 | −0.32 | 0.13 | No | No |
| F557Q | −1.87 | 0.15 | −0.40 | 0.09 | −0.98 | 0.25 | No | No |
| F557E | −1.90 | 0.10 | −1.64 | 0.09 | −1.50 | 0.16 | No | No |
| F557G | −1.17 | 0.04 | −1.02 | 0.04 | −0.98 | 0.06 | No | No |
| F557I | −0.32 | 0.05 | −0.07 | 0.04 | −0.05 | 0.08 | No | No |
| F557L | −0.04 | 0.04 | −0.08 | 0.04 | 0.14 | 0.08 | Yes | No |
| F557K | −1.25 | 0.10 | −0.84 | 0.09 | −0.79 | 0.30 | No | No |
| F557M | 0.33 | 0.07 | −0.19 | 0.08 | −0.15 | 0.18 | Yes | No |
| F557P | −1.14 | 0.10 | −1.38 | 0.11 | −1.69 | 0.21 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| F557S | −0.87 | 0.05 | −0.74 | 0.05 | −0.48 | 0.09 | No | No |
| F557* | −1.30 | 0.10 | −2.32 | 0.15 | NA | NA | Yes | No |
| F557T | −1.21 | 0.09 | −0.72 | 0.08 | −0.44 | 0.25 | No | No |
| F557W | −0.87 | 0.06 | −0.37 | 0.05 | −1.24 | 0.11 | No | No |
| F557Y | −0.74 | 0.08 | −0.15 | 0.07 | −0.87 | 0.13 | No | No |
| F557V | −0.50 | 0.04 | −0.91 | 0.05 | −0.42 | 0.04 | No | No |
| V558M | 0.24 | 0.06 | 0.15 | 0.06 | 0.10 | 0.12 | Yes | Yes |
| V558A | −0.11 | 0.04 | −0.13 | 0.04 | 0.26 | 0.09 | Yes | No |
| V558R | −0.63 | 0.06 | −0.46 | 0.05 | −0.26 | 0.14 | No | No |
| V558D | 0.64 | 0.09 | 0.05 | 0.10 | −0.46 | 0.14 | Yes | No |
| V558C | −0.01 | 0.12 | 0.01 | 0.12 | −0.28 | 0.55 | Yes | No |
| V558Q | 0.40 | 0.11 | −0.65 | 0.14 | −0.21 | 0.55 | Yes | No |
| V558E | 0.15 | 0.04 | −0.31 | 0.05 | −0.12 | 0.07 | Yes | No |
| V558G | −0.07 | 0.03 | −0.48 | 0.04 | −0.36 | 0.10 | No | No |
| V558L | 0.16 | 0.04 | 0.03 | 0.04 | −0.16 | 0.09 | Yes | No |
| V558K | 0.05 | 0.10 | −0.15 | 0.11 | −0.02 | 0.48 | Yes | No |
| V558F | −0.21 | 0.13 | −0.36 | 0.13 | NA | NA | Yes | No |
| V558S | −0.36 | 0.09 | −0.49 | 0.09 | −0.10 | 0.27 | No | No |
| V558T | −0.19 | 0.12 | −0.28 | 0.12 | 0.15 | 0.41 | Yes | No |
| V558W | −0.76 | 0.10 | −0.75 | 0.10 | −0.93 | 0.30 | No | No |
| K559A | 0.17 | 0.04 | 0.08 | 0.04 | 0.13 | 0.08 | Yes | Yes |
| K559R | 0.14 | 0.03 | −0.02 | 0.03 | 0.11 | 0.06 | Yes | No |
| K559N | 0.05 | 0.03 | 0.05 | 0.03 | −0.04 | 0.05 | Yes | No |
| K559D | 0.25 | 0.08 | −0.33 | 0.09 | −0.39 | 0.25 | Yes | No |
| K559C | 0.31 | 0.08 | −0.20 | 0.09 | −0.05 | 0.22 | Yes | No |
| K559Q | −0.23 | 0.07 | 0.03 | 0.07 | 0.00 | 0.21 | Yes | No |
| K559E | −0.20 | 0.04 | −0.52 | 0.04 | −0.40 | 0.06 | No | No |
| K559G | −0.35 | 0.03 | −0.41 | 0.03 | −0.16 | 0.03 | No | No |
| K559H | 0.53 | 0.14 | −0.21 | 0.16 | NA | NA | Yes | No |
| K559I | −0.62 | 0.12 | 0.01 | 0.10 | NA | NA | Yes | No |
| K559L | −0.39 | 0.06 | −0.29 | 0.06 | −0.71 | 0.13 | No | No |
| K559M | −0.27 | 0.06 | −0.65 | 0.07 | 0.01 | 0.12 | Yes | No |
| K559F | −0.45 | 0.13 | 0.13 | 0.11 | NA | NA | Yes | No |
| K559S | −0.28 | 0.06 | −0.32 | 0.06 | 0.22 | 0.20 | Yes | No |
| K559* | −0.63 | 0.07 | −0.48 | 0.07 | −1.15 | 0.09 | No | No |
| K559T | 0.30 | 0.06 | 0.52 | 0.06 | −0.20 | 0.15 | Yes | No |
| K559W | −0.64 | 0.06 | −0.34 | 0.06 | −0.32 | 0.18 | No | No |
| K559Y | −0.13 | 0.11 | −0.01 | 0.11 | NA | NA | Yes | No |
| K559V | −0.53 | 0.05 | −0.50 | 0.05 | −0.27 | 0.13 | No | No |
| N560A | 0.34 | 0.05 | 0.18 | 0.05 | 0.18 | 0.08 | Yes | Yes |
| N560D | 0.16 | 0.04 | 0.18 | 0.04 | 0.16 | 0.08 | Yes | Yes |
| N560E | 0.48 | 0.06 | 0.28 | 0.06 | 0.11 | 0.25 | Yes | Yes |
| N560M | 0.16 | 0.09 | 0.31 | 0.09 | 0.18 | 0.13 | Yes | Yes |
| N560R | 0.10 | 0.04 | 0.04 | 0.04 | −0.07 | 0.06 | Yes | No |
| N560C | −0.11 | 0.08 | −0.20 | 0.08 | −0.15 | 0.09 | No | No |
| N560Q | 0.55 | 0.09 | −1.07 | 0.14 | −0.09 | 0.38 | Yes | No |
| N560G | 0.01 | 0.04 | 0.03 | 0.04 | −0.02 | 0.09 | Yes | No |
| N560H | −0.35 | 0.13 | −0.17 | 0.13 | NA | NA | Yes | No |
| N560I | 0.22 | 0.05 | 0.28 | 0.05 | −0.13 | 0.10 | Yes | No |
| N560L | −0.64 | 0.08 | −0.16 | 0.07 | −0.12 | 0.11 | No | No |
| N560K | 0.11 | 0.06 | −0.29 | 0.07 | 0.14 | 0.14 | Yes | No |
| N560F | 0.14 | 0.12 | −0.03 | 0.13 | NA | NA | Yes | No |
| N560P | 0.19 | 0.09 | −0.69 | 0.11 | −0.13 | 0.29 | Yes | No |
| N560S | 0.03 | 0.03 | 0.18 | 0.03 | −0.01 | 0.05 | Yes | No |
| N560* | −1.15 | 0.11 | −1.78 | 0.15 | NA | NA | Yes | No |
| N560T | −0.40 | 0.08 | 0.00 | 0.07 | 0.01 | 0.14 | Yes | No |
| N560W | −0.36 | 0.07 | −0.72 | 0.08 | −0.27 | 0.16 | No | No |
| N560Y | −0.24 | 0.09 | 0.04 | 0.08 | 0.07 | 0.12 | Yes | No |
| N560V | 0.13 | 0.06 | −0.15 | 0.06 | −0.11 | 0.16 | Yes | No |
| G561A | −0.10 | 0.05 | −0.36 | 0.06 | −0.05 | 0.07 | No | No |
| G561R | −0.20 | 0.04 | 0.00 | 0.04 | −0.16 | 0.05 | No | No |
| G561N | 0.20 | 0.16 | 1.09 | 0.14 | NA | NA | Yes | No |
| G561D | −0.43 | 0.11 | 0.54 | 0.08 | −0.03 | 0.27 | Yes | No |
| G561C | −0.19 | 0.08 | 0.03 | 0.08 | −0.26 | 0.27 | Yes | No |
| G561Q | −0.15 | 0.12 | 0.67 | 0.10 | −0.08 | 0.26 | Yes | No |
| G561E | 0.14 | 0.06 | −0.19 | 0.06 | −0.05 | 0.14 | Yes | No |
| G561H | 0.74 | 0.14 | 1.07 | 0.14 | NA | NA | Yes | No |
| G561L | −0.57 | 0.09 | −0.30 | 0.09 | −0.60 | 0.09 | No | No |
| G561K | 0.24 | 0.12 | 0.17 | 0.12 | NA | NA | Yes | No |
| G561M | −0.33 | 0.14 | 0.12 | 0.12 | NA | NA | Yes | No |
| G561P | −0.84 | 0.12 | −0.45 | 0.11 | 0.02 | 0.17 | Yes | No |
| G561S | 0.00 | 0.06 | 0.54 | 0.05 | −0.09 | 0.18 | Yes | No |
| G561* | −0.53 | 0.11 | −0.01 | 0.09 | NA | NA | Yes | No |
| G561T | 0.10 | 0.09 | −0.87 | 0.13 | −0.23 | 0.34 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| G561W | −0.47 | 0.06 | −0.34 | 0.06 | −0.51 | 0.17 | No | No |
| G561V | −0.02 | 0.02 | −0.04 | 0.02 | 0.08 | 0.06 | Yes | No |
| L562A | −0.46 | 0.07 | −0.26 | 0.07 | −0.17 | 0.22 | No | No |
| L562R | −0.38 | 0.05 | 0.08 | 0.04 | −0.17 | 0.08 | Yes | No |
| L562D | −0.37 | 0.13 | −0.90 | 0.15 | −0.46 | 0.35 | No | No |
| L562C | 0.18 | 0.10 | −0.63 | 0.12 | 0.13 | 0.29 | Yes | No |
| L562Q | −0.43 | 0.09 | −0.20 | 0.08 | −0.07 | 0.17 | No | No |
| L562E | −0.32 | 0.07 | −0.62 | 0.08 | −0.29 | 0.18 | No | No |
| L562G | −0.75 | 0.05 | −0.60 | 0.05 | −0.36 | 0.08 | No | No |
| L562H | 0.23 | 0.12 | −0.50 | 0.15 | NA | NA | Yes | No |
| L562K | −0.69 | 0.12 | 0.32 | 0.09 | −0.53 | 0.29 | Yes | No |
| L562M | 0.19 | 0.06 | −0.26 | 0.07 | −0.04 | 0.12 | Yes | No |
| L562F | 0.48 | 0.14 | 0.79 | 0.13 | NA | NA | Yes | No |
| L562P | −0.10 | 0.06 | −0.05 | 0.06 | −0.26 | 0.09 | No | No |
| L562S | −0.65 | 0.10 | −0.27 | 0.09 | −0.04 | 0.26 | No | No |
| L562* | −1.29 | 0.14 | −1.10 | 0.13 | NA | NA | Yes | No |
| L562T | −1.14 | 0.15 | −1.09 | 0.15 | NA | NA | Yes | No |
| L562W | −0.37 | 0.07 | −0.38 | 0.07 | −0.45 | 0.18 | No | No |
| L562Y | −0.63 | 0.16 | −0.49 | 0.16 | NA | NA | Yes | No |
| L562V | −0.20 | 0.05 | −0.49 | 0.06 | −0.71 | 0.11 | No | No |
| Y563A | −1.58 | 0.09 | −1.18 | 0.08 | −1.03 | 0.07 | No | No |
| Y563R | −1.46 | 0.06 | −1.08 | 0.05 | −1.59 | 0.11 | No | No |
| Y563N | −0.16 | 0.08 | 0.04 | 0.07 | −0.30 | 0.16 | Yes | No |
| Y563D | −0.56 | 0.07 | −0.65 | 0.07 | −0.73 | 0.07 | No | No |
| Y563C | −0.49 | 0.06 | −0.50 | 0.06 | −0.32 | 0.09 | No | No |
| Y563Q | −0.48 | 0.10 | −0.52 | 0.10 | −0.93 | 0.25 | No | No |
| Y563E | −1.21 | 0.08 | 0.07 | 0.06 | −1.73 | 0.14 | Yes | No |
| Y563G | −1.13 | 0.04 | −1.64 | 0.05 | −1.26 | 0.03 | No | No |
| Y563H | −0.25 | 0.08 | −0.14 | 0.08 | −0.06 | 0.15 | No | No |
| Y563L | −1.95 | 0.12 | −1.69 | 0.11 | −1.15 | 0.19 | No | No |
| Y563F | 0.13 | 0.07 | 0.06 | 0.07 | −0.06 | 0.11 | Yes | No |
| Y563S | −0.91 | 0.07 | −0.95 | 0.07 | −0.96 | 0.08 | No | No |
| Y563* | −0.54 | 0.08 | −0.93 | 0.09 | −1.33 | 0.14 | No | No |
| Y563T | −1.67 | 0.15 | 0.09 | 0.08 | −0.51 | 0.22 | Yes | No |
| Y563W | −0.84 | 0.06 | −0.78 | 0.05 | −1.12 | 0.11 | No | No |
| Y563V | −1.32 | 0.08 | −1.12 | 0.07 | −1.13 | 0.17 | No | No |
| Y564A | −1.20 | 0.15 | −0.93 | 0.14 | NA | NA | Yes | No |
| Y564R | −1.37 | 0.10 | −1.99 | 0.13 | −1.19 | 0.19 | No | No |
| Y564N | −0.18 | 0.12 | 0.08 | 0.11 | −0.14 | 0.21 | Yes | No |
| Y564D | −0.05 | 0.06 | −0.60 | 0.07 | −0.25 | 0.10 | No | No |
| Y564C | 0.09 | 0.05 | −0.22 | 0.05 | −0.08 | 0.10 | Yes | No |
| Y564G | −1.96 | 0.11 | −1.74 | 0.10 | −1.32 | 0.19 | No | No |
| Y564H | −0.05 | 0.08 | −0.10 | 0.08 | 0.04 | 0.13 | Yes | No |
| Y564L | −0.24 | 0.10 | −1.01 | 0.13 | NA | NA | Yes | No |
| Y564F | −0.04 | 0.11 | 0.35 | 0.10 | NA | NA | Yes | No |
| Y564S | −0.47 | 0.09 | −0.36 | 0.08 | −0.35 | 0.20 | No | No |
| Y564* | −0.43 | 0.11 | −0.68 | 0.12 | NA | NA | Yes | No |
| Y564W | −0.37 | 0.10 | 0.03 | 0.09 | −0.52 | 0.29 | Yes | No |
| Y564V | −1.90 | 0.15 | −0.72 | 0.10 | NA | NA | Yes | No |
| L565A | −0.65 | 0.07 | −0.47 | 0.06 | −1.27 | 0.23 | No | No |
| L565R | −0.27 | 0.03 | −0.79 | 0.03 | −0.12 | 0.05 | No | No |
| L565C | −1.21 | 0.13 | −0.10 | 0.09 | −0.66 | 0.24 | No | No |
| L565Q | −0.36 | 0.08 | −0.84 | 0.09 | −0.76 | 0.15 | No | No |
| L565E | −1.93 | 0.12 | −1.02 | 0.09 | −1.55 | 0.19 | No | No |
| L565G | −2.36 | 0.08 | −1.62 | 0.06 | −1.50 | 0.10 | No | No |
| L565I | −0.07 | 0.13 | −0.42 | 0.14 | NA | NA | Yes | No |
| L565M | −0.20 | 0.07 | −0.26 | 0.07 | 0.03 | 0.10 | Yes | No |
| L565P | −0.60 | 0.07 | −0.92 | 0.08 | −0.67 | 0.13 | No | No |
| L565S | −1.07 | 0.09 | −0.75 | 0.08 | −1.13 | 0.08 | No | No |
| L565W | −1.64 | 0.10 | −2.31 | 0.13 | NA | NA | Yes | No |
| L565V | −0.57 | 0.06 | −0.48 | 0.05 | −1.19 | 0.13 | No | No |
| G566A | −0.36 | 0.08 | −0.39 | 0.08 | −0.57 | 0.21 | No | No |
| G566R | −1.37 | 0.09 | −1.97 | 0.12 | −1.83 | 0.11 | No | No |
| G566D | −0.67 | 0.11 | −1.03 | 0.12 | −0.62 | 0.18 | No | No |
| G566C | −0.08 | 0.11 | −0.83 | 0.13 | NA | NA | Yes | No |
| G566S | −0.14 | 0.06 | −0.40 | 0.07 | −0.18 | 0.11 | No | No |
| G566V | −0.52 | 0.07 | −0.99 | 0.08 | −0.68 | 0.10 | No | No |
| I567A | −1.35 | 0.11 | −1.01 | 0.09 | −1.13 | 0.07 | No | No |
| I567R | −1.78 | 0.09 | −0.11 | 0.05 | −1.44 | 0.11 | No | No |
| I567N | −0.05 | 0.07 | −0.10 | 0.07 | 0.15 | 0.10 | Yes | No |
| I567E | −1.64 | 0.12 | −1.70 | 0.13 | NA | NA | Yes | No |
| I567G | −1.23 | 0.06 | −1.14 | 0.06 | −1.70 | 0.09 | No | No |
| I567L | −0.67 | 0.08 | 0.29 | 0.06 | −0.48 | 0.13 | Yes | No |
| I567M | −0.51 | 0.09 | −0.82 | 0.10 | −0.88 | 0.10 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| I567F | −0.43 | 0.12 | 0.00 | 0.11 | −0.48 | 0.19 | No | No |
| I567S | −0.56 | 0.07 | −0.67 | 0.07 | −0.82 | 0.12 | No | No |
| I567T | −0.15 | 0.05 | −0.27 | 0.06 | 0.13 | 0.09 | Yes | No |
| I567W | −1.85 | 0.12 | −2.17 | 0.14 | −1.22 | 0.13 | No | No |
| I567V | −0.54 | 0.05 | −0.26 | 0.05 | −0.68 | 0.08 | No | No |
| M568A | −0.52 | 0.06 | −0.34 | 0.06 | −0.04 | 0.11 | No | No |
| M568R | −0.30 | 0.04 | −0.82 | 0.05 | −0.20 | 0.07 | No | No |
| M568C | −0.33 | 0.10 | −0.78 | 0.11 | −0.18 | 0.28 | No | No |
| M568Q | −0.61 | 0.12 | −0.40 | 0.12 | NA | NA | Yes | No |
| M568E | −1.29 | 0.09 | −0.86 | 0.08 | −1.65 | 0.22 | No | No |
| M568G | −1.32 | 0.05 | −0.45 | 0.04 | −0.80 | 0.04 | No | No |
| M568H | 0.40 | 0.14 | −0.11 | 0.15 | NA | NA | Yes | No |
| M568I | 0.16 | 0.05 | −0.01 | 0.06 | 0.15 | 0.11 | Yes | No |
| M568L | −0.42 | 0.06 | −0.23 | 0.05 | −0.27 | 0.09 | No | No |
| M568K | −0.19 | 0.08 | −0.20 | 0.08 | −0.17 | 0.16 | No | No |
| M568P | −1.11 | 0.13 | −0.81 | 0.12 | NA | NA | Yes | No |
| M568S | 0.29 | 0.06 | −0.47 | 0.07 | −0.54 | 0.22 | Yes | No |
| M568T | −0.13 | 0.06 | −0.25 | 0.06 | −0.07 | 0.12 | No | No |
| M568W | −0.20 | 0.06 | 0.14 | 0.05 | −0.93 | 0.18 | Yes | No |
| M568V | −0.26 | 0.04 | −0.28 | 0.04 | 0.06 | 0.08 | Yes | No |
| P569D | 0.60 | 0.08 | 0.33 | 0.08 | 1.25 | 0.11 | Yes | Yes |
| P569A | −0.12 | 0.05 | −0.39 | 0.05 | 0.23 | 0.08 | Yes | No |
| P569R | −0.60 | 0.04 | −0.52 | 0.04 | −0.13 | 0.05 | No | No |
| P569N | −0.14 | 0.14 | −0.71 | 0.16 | NA | NA | Yes | No |
| P569C | −1.16 | 0.09 | −0.36 | 0.07 | 0.07 | 0.19 | Yes | No |
| P569Q | −0.26 | 0.09 | −0.13 | 0.09 | 0.40 | 0.21 | Yes | No |
| P569E | −0.07 | 0.07 | −0.16 | 0.07 | −0.11 | 0.22 | No | No |
| P569G | −0.54 | 0.03 | −0.49 | 0.03 | −0.65 | 0.07 | No | No |
| P569H | 0.12 | 0.09 | −0.25 | 0.10 | 0.16 | 0.17 | Yes | No |
| P569I | 0.03 | 0.13 | −0.32 | 0.14 | 0.10 | 0.31 | Yes | No |
| P569L | −0.47 | 0.05 | −0.21 | 0.04 | −0.30 | 0.11 | No | No |
| P569K | −0.35 | 0.12 | 0.36 | 0.10 | 0.23 | 0.31 | Yes | No |
| P569M | −0.98 | 0.11 | −0.54 | 0.10 | −0.28 | 0.12 | No | No |
| P569F | NA | NA | NA | NA | −0.67 | 0.31 | Yes | No |
| P569S | −0.07 | 0.05 | −0.24 | 0.05 | 0.02 | 0.11 | Yes | No |
| P569T | −0.38 | 0.07 | −0.20 | 0.07 | −0.06 | 0.15 | No | No |
| P569W | −0.74 | 0.06 | −1.07 | 0.07 | −1.18 | 0.14 | No | No |
| P569V | −0.34 | 0.04 | −0.82 | 0.05 | 0.15 | 0.14 | Yes | No |
| K570A | −0.95 | 0.06 | −0.28 | 0.05 | −1.70 | 0.16 | No | No |
| K570R | −0.47 | 0.03 | −0.56 | 0.04 | −0.39 | 0.05 | No | No |
| K570N | −0.30 | 0.11 | −0.73 | 0.12 | NA | NA | Yes | No |
| K570D | −1.38 | 0.12 | −1.42 | 0.13 | NA | NA | Yes | No |
| K570C | −1.71 | 0.11 | −1.70 | 0.11 | NA | NA | Yes | No |
| K570Q | −0.90 | 0.09 | −0.32 | 0.08 | −1.25 | 0.18 | No | No |
| K570E | −1.37 | 0.07 | −0.71 | 0.05 | −1.40 | 0.10 | No | No |
| K570G | −0.62 | 0.03 | −0.33 | 0.03 | −1.61 | 0.09 | No | No |
| K570L | −1.83 | 0.08 | −1.48 | 0.07 | −1.35 | 0.14 | No | No |
| K570M | −1.02 | 0.09 | −0.76 | 0.09 | −1.52 | 0.18 | No | No |
| K570P | −1.15 | 0.12 | −0.12 | 0.09 | NA | NA | Yes | No |
| K570S | −1.28 | 0.09 | −0.51 | 0.07 | −1.52 | 0.14 | No | No |
| K570* | −1.31 | 0.10 | −1.26 | 0.10 | −1.24 | 0.15 | No | No |
| K570T | −0.02 | 0.03 | 0.11 | 0.03 | −0.05 | 0.03 | Yes | No |
| K570W | −2.06 | 0.09 | −2.64 | 0.12 | −1.61 | 0.14 | No | No |
| K570V | −1.33 | 0.06 | −0.81 | 0.05 | −1.85 | 0.11 | No | No |
| Q571A | 0.64 | 0.07 | 0.39 | 0.08 | 1.09 | 0.23 | Yes | Yes |
| Q571P | 0.17 | 0.07 | 0.61 | 0.07 | 0.13 | 0.14 | Yes | Yes |
| Q571S | 0.25 | 0.09 | 0.20 | 0.09 | 0.89 | 0.23 | Yes | Yes |
| Q571T | 0.22 | 0.13 | 0.19 | 0.13 | 0.87 | 0.41 | Yes | Yes |
| Q571R | −0.03 | 0.04 | −0.43 | 0.05 | 0.19 | 0.10 | Yes | No |
| Q571C | −0.60 | 0.16 | 0.23 | 0.12 | −0.33 | 0.24 | Yes | No |
| Q571E | −0.22 | 0.05 | −0.40 | 0.06 | −0.17 | 0.05 | No | No |
| Q571G | 0.00 | 0.06 | −0.25 | 0.06 | −0.41 | 0.18 | No | No |
| Q571H | −0.23 | 0.11 | −0.65 | 0.12 | 0.06 | 0.24 | Yes | No |
| Q571L | −0.41 | 0.07 | −0.45 | 0.07 | −0.66 | 0.11 | No | No |
| Q571K | −0.47 | 0.16 | −0.33 | 0.15 | 0.08 | 0.31 | Yes | No |
| Q571* | −0.59 | 0.11 | −0.27 | 0.10 | −0.67 | 0.17 | No | No |
| Q571W | −0.09 | 0.08 | −0.80 | 0.09 | −0.51 | 0.24 | No | No |
| Q571V | −0.36 | 0.11 | −0.20 | 0.10 | −0.44 | 0.32 | No | No |
| K572E | 0.11 | 0.04 | 0.25 | 0.04 | 0.42 | 0.08 | Yes | Yes |
| K572A | −0.24 | 0.04 | 0.33 | 0.04 | −0.11 | 0.11 | Yes | No |
| K572R | −0.08 | 0.03 | −0.05 | 0.03 | 0.03 | 0.03 | Yes | No |
| K572N | −0.17 | 0.07 | 0.17 | 0.06 | 0.02 | 0.11 | Yes | No |
| K572D | −0.09 | 0.09 | 0.03 | 0.08 | 0.45 | 0.19 | Yes | No |
| K572C | 0.23 | 0.07 | −0.87 | 0.09 | −0.19 | 0.25 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| K572Q | −0.21 | 0.06 | 0.11 | 0.06 | 0.37 | 0.16 | Yes | No |
| K572G | −0.17 | 0.03 | −0.08 | 0.03 | 0.42 | 0.03 | Yes | No |
| K572H | NA | NA | NA | NA | 0.11 | 0.33 | Yes | No |
| K572L | −0.11 | 0.05 | 0.16 | 0.05 | −0.32 | 0.15 | Yes | No |
| K572M | −0.71 | 0.08 | 0.02 | 0.06 | 0.21 | 0.06 | Yes | No |
| K572P | 0.09 | 0.06 | 0.91 | 0.06 | −0.88 | 0.23 | Yes | No |
| K572S | 0.30 | 0.05 | 0.01 | 0.05 | −0.29 | 0.15 | Yes | No |
| K572* | −1.34 | 0.08 | −0.86 | 0.07 | −0.86 | 0.08 | No | No |
| K572T | −0.04 | 0.04 | −0.09 | 0.04 | −0.24 | 0.07 | No | No |
| K572W | −0.46 | 0.05 | −0.47 | 0.05 | −0.68 | 0.14 | No | No |
| K572Y | −1.04 | 0.16 | −1.01 | 0.15 | NA | NA | Yes | No |
| K572V | −0.08 | 0.04 | −0.31 | 0.04 | −0.71 | 0.04 | No | No |
| G573A | 0.04 | 0.04 | −0.11 | 0.04 | −0.99 | 0.09 | Yes | No |
| G573R | −0.04 | 0.03 | −0.31 | 0.04 | −0.66 | 0.08 | No | No |
| G573N | 0.45 | 0.12 | −0.94 | 0.17 | −0.29 | 0.41 | Yes | No |
| G573D | −0.05 | 0.06 | −0.41 | 0.07 | −0.95 | 0.13 | No | No |
| G573C | −0.22 | 0.06 | −0.35 | 0.06 | −0.42 | 0.11 | No | No |
| G573Q | 0.40 | 0.07 | −0.29 | 0.08 | −0.43 | 0.26 | Yes | No |
| G573E | −0.09 | 0.05 | 0.36 | 0.05 | −0.50 | 0.08 | Yes | No |
| G573H | −0.77 | 0.12 | 0.37 | 0.09 | −0.51 | 0.30 | Yes | No |
| G573L | −0.04 | 0.05 | 0.07 | 0.05 | −0.43 | 0.05 | Yes | No |
| G573K | −1.43 | 0.13 | −0.29 | 0.09 | −0.32 | 0.25 | No | No |
| G573M | −0.32 | 0.10 | −0.32 | 0.09 | −0.28 | 0.26 | No | No |
| G573F | −0.45 | 0.14 | −0.19 | 0.12 | NA | NA | Yes | No |
| G573P | 0.16 | 0.06 | −0.38 | 0.06 | −0.10 | 0.21 | Yes | No |
| G573S | 0.11 | 0.04 | −0.42 | 0.05 | −0.55 | 0.10 | Yes | No |
| G573* | −1.18 | 0.12 | −1.27 | 0.12 | −0.75 | 0.28 | No | No |
| G573T | 0.02 | 0.08 | −0.53 | 0.09 | −0.62 | 0.08 | Yes | No |
| G573W | −0.08 | 0.05 | −0.60 | 0.05 | −0.67 | 0.09 | No | No |
| G573Y | 0.13 | 0.11 | −0.81 | 0.14 | −0.48 | 0.30 | Yes | No |
| G573V | −0.06 | 0.04 | −0.40 | 0.04 | −0.71 | 0.06 | No | No |
| R574A | −0.83 | 0.07 | −0.54 | 0.06 | −0.64 | 0.10 | No | No |
| R574N | −0.85 | 0.17 | −0.69 | 0.16 | NA | NA | Yes | No |
| R574D | −0.32 | 0.10 | −1.05 | 0.13 | NA | NA | Yes | No |
| R574C | 0.58 | 0.07 | 0.15 | 0.07 | −1.16 | 0.22 | Yes | No |
| R574Q | NA | NA | NA | NA | −1.08 | 0.26 | Yes | No |
| R574E | −0.53 | 0.08 | −0.38 | 0.07 | −1.34 | 0.15 | No | No |
| R574G | −0.21 | 0.03 | −0.27 | 0.03 | −0.60 | 0.07 | No | No |
| R574I | −0.50 | 0.11 | −0.47 | 0.11 | NA | NA | Yes | No |
| R574L | −0.36 | 0.07 | −0.25 | 0.07 | −0.78 | 0.18 | No | No |
| R574K | −0.33 | 0.08 | 0.42 | 0.06 | −0.33 | 0.17 | Yes | No |
| R574M | 0.51 | 0.07 | −0.36 | 0.08 | −0.64 | 0.07 | Yes | No |
| R574F | 0.06 | 0.12 | −0.99 | 0.16 | NA | NA | Yes | No |
| R574P | −0.38 | 0.13 | 0.11 | 0.11 | −0.72 | 0.23 | Yes | No |
| R574S | 0.12 | 0.04 | 0.02 | 0.04 | −1.04 | 0.03 | Yes | No |
| R574* | −0.34 | 0.07 | −0.51 | 0.07 | −0.84 | 0.09 | No | No |
| R574T | −0.65 | 0.09 | 0.35 | 0.07 | −0.83 | 0.16 | Yes | No |
| R574W | −0.10 | 0.05 | −0.10 | 0.05 | −0.73 | 0.06 | No | No |
| R574Y | −0.25 | 0.12 | 0.13 | 0.11 | NA | NA | Yes | No |
| R574V | 0.59 | 0.05 | −0.27 | 0.05 | −1.08 | 0.14 | Yes | No |
| Y575G | 0.53 | 0.04 | 0.21 | 0.04 | 0.32 | 0.07 | Yes | Yes |
| Y575M | 0.89 | 0.11 | 0.27 | 0.12 | 0.31 | 0.41 | Yes | Yes |
| Y575A | 0.55 | 0.05 | 0.01 | 0.06 | −0.07 | 0.18 | Yes | No |
| Y575R | 0.15 | 0.05 | −0.04 | 0.06 | −0.56 | 0.10 | Yes | No |
| Y575N | −0.07 | 0.10 | 0.34 | 0.09 | −0.21 | 0.10 | Yes | No |
| Y575D | −0.07 | 0.09 | 0.15 | 0.09 | −0.45 | 0.25 | Yes | No |
| Y575C | 0.20 | 0.06 | 0.17 | 0.06 | −0.26 | 0.09 | Yes | No |
| Y575Q | −0.22 | 0.13 | −0.32 | 0.13 | −0.16 | 0.30 | No | No |
| Y575E | 0.03 | 0.08 | −0.32 | 0.09 | −0.41 | 0.35 | Yes | No |
| Y575H | −0.24 | 0.08 | −0.29 | 0.08 | 0.23 | 0.13 | Yes | No |
| Y575I | 0.04 | 0.14 | −0.37 | 0.15 | NA | NA | Yes | No |
| Y575L | −0.05 | 0.07 | −0.43 | 0.08 | −0.22 | 0.23 | No | No |
| Y575K | 0.95 | 0.11 | 0.22 | 0.12 | NA | NA | Yes | No |
| Y575F | 0.14 | 0.08 | −0.45 | 0.09 | −0.16 | 0.12 | Yes | No |
| Y575P | −0.06 | 0.09 | −0.22 | 0.09 | −0.14 | 0.31 | No | No |
| Y575S | 0.02 | 0.06 | 0.01 | 0.06 | −0.07 | 0.09 | Yes | No |
| Y575* | −0.20 | 0.07 | −0.46 | 0.08 | −0.51 | 0.12 | No | No |
| Y575T | −0.55 | 0.10 | −0.40 | 0.09 | −0.14 | 0.30 | No | No |
| Y575W | −0.44 | 0.09 | 0.31 | 0.07 | −0.36 | 0.16 | Yes | No |
| Y575V | −0.10 | 0.07 | −0.35 | 0.07 | −0.29 | 0.24 | No | No |
| K576C | 0.27 | 0.07 | 0.25 | 0.07 | 0.10 | 0.26 | Yes | Yes |
| K576A | −0.05 | 0.05 | 0.16 | 0.05 | 0.27 | 0.06 | Yes | No |
| K576R | −0.31 | 0.03 | −0.11 | 0.03 | 0.05 | 0.07 | Yes | No |
| K576N | −0.28 | 0.08 | −0.47 | 0.08 | −0.11 | 0.15 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| K576D | −0.01 | 0.08 | −0.22 | 0.09 | −1.04 | 0.26 | No | No |
| K576Q | −0.06 | 0.06 | 0.02 | 0.05 | 0.57 | 0.08 | Yes | No |
| K576E | −0.63 | 0.05 | −0.38 | 0.05 | −0.27 | 0.09 | No | No |
| K576G | −0.03 | 0.03 | −0.13 | 0.03 | 0.28 | 0.04 | Yes | No |
| K576H | −0.26 | 0.14 | −0.46 | 0.14 | NA | NA | Yes | No |
| K576I | 0.10 | 0.11 | −0.10 | 0.12 | 0.37 | 0.16 | Yes | No |
| K576L | −0.04 | 0.05 | 0.01 | 0.04 | 0.24 | 0.05 | Yes | No |
| K576M | 0.21 | 0.05 | −0.14 | 0.06 | 0.07 | 0.09 | Yes | No |
| K576F | −0.41 | 0.13 | −1.12 | 0.15 | 0.20 | 0.34 | Yes | No |
| K576P | −0.07 | 0.09 | −1.70 | 0.14 | −0.15 | 0.17 | No | No |
| K576S | −0.20 | 0.05 | −0.43 | 0.06 | 0.64 | 0.15 | Yes | No |
| K576* | −1.75 | 0.10 | −1.41 | 0.08 | −0.09 | 0.15 | No | No |
| K576T | −0.05 | 0.06 | 0.30 | 0.05 | 0.20 | 0.08 | Yes | No |
| K576W | −0.33 | 0.05 | −0.65 | 0.05 | −0.56 | 0.13 | No | No |
| K576Y | −1.23 | 0.16 | −0.48 | 0.12 | NA | NA | Yes | No |
| K576V | −0.36 | 0.04 | −0.69 | 0.05 | 0.38 | 0.07 | Yes | No |
| A577R | −0.12 | 0.03 | −0.60 | 0.04 | 0.88 | 0.06 | Yes | No |
| A577N | 0.11 | 0.09 | −0.85 | 0.11 | 0.34 | 0.13 | Yes | No |
| A577D | −0.06 | 0.05 | −0.11 | 0.05 | −0.37 | 0.13 | No | No |
| A577C | −0.24 | 0.06 | −0.02 | 0.06 | −0.39 | 0.20 | No | No |
| A577Q | −0.37 | 0.07 | 0.63 | 0.06 | 0.10 | 0.23 | Yes | No |
| A577E | −0.66 | 0.05 | −2.12 | 0.09 | −0.27 | 0.14 | No | No |
| A577G | 0.22 | 0.02 | −0.05 | 0.03 | 0.49 | 0.05 | Yes | No |
| A577H | 0.02 | 0.08 | −0.59 | 0.10 | 0.25 | 0.22 | Yes | No |
| A577I | −0.94 | 0.12 | −0.35 | 0.10 | NA | NA | Yes | No |
| A577L | −0.90 | 0.06 | −0.37 | 0.05 | −0.15 | 0.06 | No | No |
| A577K | −0.40 | 0.08 | −0.80 | 0.09 | 1.09 | 0.07 | Yes | No |
| A577M | −0.40 | 0.08 | −0.20 | 0.07 | −0.28 | 0.20 | No | No |
| A577F | −0.79 | 0.11 | −0.99 | 0.12 | −0.78 | 0.19 | No | No |
| A577P | −0.25 | 0.06 | −0.11 | 0.05 | −0.29 | 0.11 | No | No |
| A577S | −0.31 | 0.04 | −0.26 | 0.04 | 0.08 | 0.10 | Yes | No |
| A577* | −1.65 | 0.11 | −1.75 | 0.11 | NA | NA | Yes | No |
| A577T | −0.09 | 0.05 | −0.38 | 0.05 | −0.02 | 0.08 | No | No |
| A577W | −0.63 | 0.05 | −0.66 | 0.05 | −0.66 | 0.08 | No | No |
| A577Y | −0.22 | 0.09 | −0.20 | 0.09 | 0.05 | 0.32 | Yes | No |
| A577V | −0.06 | 0.03 | −0.28 | 0.04 | −0.42 | 0.09 | No | No |
| L578A | −0.22 | 0.03 | −0.43 | 0.03 | −0.20 | 0.07 | No | No |
| L578R | −0.11 | 0.02 | −0.49 | 0.02 | 0.04 | 0.03 | Yes | No |
| L578N | −0.35 | 0.11 | −0.09 | 0.10 | −0.47 | 0.23 | No | No |
| L578D | −0.09 | 0.06 | −0.41 | 0.06 | −0.92 | 0.07 | No | No |
| L578C | 0.05 | 0.04 | −0.34 | 0.05 | −0.03 | 0.10 | Yes | No |
| L578Q | 0.11 | 0.04 | −0.12 | 0.05 | 0.00 | 0.10 | Yes | No |
| L578E | −0.33 | 0.04 | −0.53 | 0.04 | −0.77 | 0.12 | No | No |
| L578G | −0.26 | 0.02 | −0.45 | 0.02 | −0.29 | 0.02 | No | No |
| L578H | −0.27 | 0.07 | 0.10 | 0.06 | 0.03 | 0.14 | Yes | No |
| L578I | −0.28 | 0.09 | 0.32 | 0.08 | 0.22 | 0.23 | Yes | No |
| L578K | −0.62 | 0.07 | −1.21 | 0.09 | 0.50 | 0.20 | Yes | No |
| L578M | −0.12 | 0.03 | −0.21 | 0.03 | −0.03 | 0.05 | No | No |
| L578F | 0.36 | 0.06 | 0.21 | 0.06 | −0.12 | 0.14 | Yes | No |
| L578P | −0.62 | 0.05 | 0.03 | 0.04 | −0.31 | 0.06 | Yes | No |
| L578S | −0.37 | 0.04 | −0.33 | 0.04 | −0.08 | 0.09 | No | No |
| L578* | −1.90 | 0.09 | −1.28 | 0.07 | −1.24 | 0.09 | No | No |
| L578T | −0.29 | 0.06 | −0.06 | 0.05 | 0.26 | 0.06 | Yes | No |
| L578W | −0.37 | 0.03 | −0.41 | 0.03 | −0.08 | 0.04 | No | No |
| L578Y | 0.36 | 0.07 | −0.21 | 0.07 | −0.24 | 0.07 | Yes | No |
| L578V | −0.19 | 0.03 | −0.28 | 0.03 | 0.01 | 0.04 | Yes | No |
| S579T | 0.17 | 0.04 | 0.33 | 0.04 | 0.01 | 0.06 | Yes | Yes |
| S579V | 0.04 | 0.03 | 0.02 | 0.03 | 0.05 | 0.07 | Yes | Yes |
| S579A | −0.06 | 0.03 | 0.06 | 0.02 | 0.08 | 0.03 | Yes | No |
| S579R | 0.04 | 0.03 | −0.11 | 0.03 | −0.15 | 0.05 | Yes | No |
| S579N | −0.19 | 0.07 | −0.45 | 0.08 | −0.39 | 0.23 | No | No |
| S579D | −0.39 | 0.06 | −0.43 | 0.06 | 0.03 | 0.06 | Yes | No |
| S579C | 0.02 | 0.03 | 0.07 | 0.03 | −0.02 | 0.05 | Yes | No |
| S579Q | −0.19 | 0.07 | −0.66 | 0.08 | 0.30 | 0.20 | Yes | No |
| S579E | −0.10 | 0.04 | −0.54 | 0.05 | −0.15 | 0.05 | No | No |
| S579G | −0.25 | 0.03 | −0.12 | 0.02 | 0.11 | 0.05 | Yes | No |
| S579H | 0.09 | 0.08 | −0.15 | 0.08 | −0.18 | 0.12 | Yes | No |
| S579I | −0.05 | 0.06 | 0.25 | 0.06 | 0.04 | 0.15 | Yes | No |
| S579L | −0.65 | 0.04 | −0.32 | 0.04 | 0.11 | 0.05 | Yes | No |
| S579K | −0.15 | 0.06 | −0.55 | 0.07 | 0.13 | 0.22 | Yes | No |
| S579M | −0.18 | 0.06 | 0.05 | 0.05 | 0.28 | 0.19 | Yes | No |
| S579F | 0.27 | 0.04 | 0.16 | 0.04 | −0.08 | 0.07 | Yes | No |
| S579P | −0.19 | 0.05 | −0.75 | 0.05 | −0.05 | 0.10 | No | No |
| S579* | −1.34 | 0.08 | −1.06 | 0.07 | −1.30 | 0.11 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| S579W | −0.09 | 0.04 | −0.35 | 0.04 | −0.37 | 0.06 | No | No |
| S579Y | −0.06 | 0.05 | −0.21 | 0.05 | −0.36 | 0.04 | No | No |
| F580A | −0.80 | 0.08 | −0.25 | 0.07 | −1.44 | 0.19 | No | No |
| F580R | −1.58 | 0.09 | −1.48 | 0.08 | −1.26 | 0.19 | No | No |
| F580C | −0.22 | 0.09 | −0.47 | 0.10 | −0.11 | 0.18 | No | No |
| F580E | −0.96 | 0.12 | −0.21 | 0.09 | NA | NA | Yes | No |
| F580G | −0.91 | 0.05 | −1.05 | 0.05 | −1.21 | 0.04 | No | No |
| F580I | −0.14 | 0.09 | −0.06 | 0.09 | −0.17 | 0.28 | No | No |
| F580L | −0.11 | 0.05 | −0.28 | 0.05 | 0.01 | 0.09 | Yes | No |
| F580M | 0.31 | 0.12 | −0.37 | 0.14 | NA | NA | Yes | No |
| F580P | NA | NA | NA | NA | −0.75 | 0.28 | Yes | No |
| F580S | −0.22 | 0.07 | −0.70 | 0.07 | −0.67 | 0.10 | No | No |
| F580W | −1.14 | 0.10 | 0.30 | 0.07 | 0.67 | 0.24 | Yes | No |
| F580Y | 0.39 | 0.11 | −0.45 | 0.14 | −0.09 | 0.23 | Yes | No |
| F580V | 0.18 | 0.06 | −0.33 | 0.06 | −0.52 | 0.13 | Yes | No |
| E581A | −0.08 | 0.03 | 0.16 | 0.03 | −0.13 | 0.06 | Yes | No |
| E581R | −0.31 | 0.03 | −0.14 | 0.03 | −0.36 | 0.04 | No | No |
| E581N | −0.14 | 0.15 | 0.56 | 0.13 | NA | NA | Yes | No |
| E581D | 0.04 | 0.06 | 0.25 | 0.06 | −0.21 | 0.09 | Yes | No |
| E581C | 0.12 | 0.07 | 0.54 | 0.06 | −0.12 | 0.15 | Yes | No |
| E581Q | 0.01 | 0.04 | 0.09 | 0.04 | −0.12 | 0.06 | Yes | No |
| E581G | −0.15 | 0.02 | −0.05 | 0.02 | −0.03 | 0.03 | No | No |
| E581H | −0.31 | 0.12 | 1.00 | 0.10 | −0.67 | 0.35 | Yes | No |
| E581I | −0.12 | 0.14 | 0.03 | 0.13 | 0.40 | 0.44 | Yes | No |
| E581L | 0.09 | 0.04 | −0.12 | 0.04 | 0.29 | 0.12 | Yes | No |
| E581K | −0.10 | 0.05 | −0.02 | 0.05 | −0.33 | 0.07 | No | No |
| E581M | −0.05 | 0.08 | −0.79 | 0.09 | 0.12 | 0.13 | Yes | No |
| E581F | −0.32 | 0.11 | −0.09 | 0.10 | −0.40 | 0.30 | No | No |
| E581P | −0.49 | 0.07 | −0.09 | 0.06 | −0.25 | 0.13 | No | No |
| E581S | 0.00 | 0.05 | −1.01 | 0.06 | −0.11 | 0.06 | Yes | No |
| E581* | −1.00 | 0.07 | −0.93 | 0.07 | −0.92 | 0.13 | No | No |
| E581T | −0.23 | 0.07 | −0.29 | 0.07 | 0.06 | 0.09 | Yes | No |
| E581W | 0.25 | 0.04 | −0.31 | 0.04 | 0.04 | 0.05 | Yes | No |
| E581Y | NA | NA | NA | NA | 0.25 | 0.28 | Yes | No |
| E581V | −0.18 | 0.04 | 0.31 | 0.03 | 0.26 | 0.10 | Yes | No |
| P582A | −0.46 | 0.07 | −0.64 | 0.07 | −0.60 | 0.13 | No | No |
| P582R | 0.24 | 0.05 | −0.24 | 0.06 | −0.48 | 0.17 | Yes | No |
| P582N | −0.02 | 0.05 | −0.24 | 0.05 | −0.22 | 0.11 | No | No |
| P582D | −0.41 | 0.18 | −0.64 | 0.18 | NA | NA | Yes | No |
| P582C | 0.14 | 0.11 | −0.07 | 0.12 | 0.17 | 0.64 | Yes | No |
| P582Q | −0.74 | 0.13 | −0.13 | 0.11 | −0.07 | 0.25 | No | No |
| P582G | −0.10 | 0.06 | −0.80 | 0.07 | −0.50 | 0.18 | No | No |
| P582H | −0.03 | 0.02 | −0.15 | 0.02 | −0.12 | 0.04 | No | No |
| P582L | −0.14 | 0.07 | −0.96 | 0.08 | −0.26 | 0.13 | No | No |
| P582K | −0.33 | 0.19 | 0.97 | 0.15 | NA | NA | Yes | No |
| P582F | NA | NA | NA | NA | 0.02 | 0.55 | Yes | No |
| P582S | 0.19 | 0.06 | 0.48 | 0.05 | −1.33 | 0.16 | Yes | No |
| P582T | −0.13 | 0.03 | −0.19 | 0.03 | −0.48 | 0.06 | No | No |
| P582W | −1.46 | 0.15 | −0.73 | 0.11 | −0.12 | 0.35 | No | No |
| P582V | −0.90 | 0.10 | −0.27 | 0.08 | −0.81 | 0.09 | No | No |
| T583I | 0.04 | 0.08 | 0.11 | 0.07 | 0.07 | 0.17 | Yes | Yes |
| T583A | 0.02 | 0.04 | −0.22 | 0.04 | −0.17 | 0.08 | Yes | No |
| T583R | 0.12 | 0.05 | −0.31 | 0.05 | −0.04 | 0.09 | Yes | No |
| T583N | 0.00 | 0.06 | 0.01 | 0.06 | −0.20 | 0.09 | Yes | No |
| T583D | 0.23 | 0.12 | −0.96 | 0.16 | NA | NA | Yes | No |
| T583C | 0.67 | 0.09 | −0.82 | 0.12 | −0.67 | 0.27 | Yes | No |
| T583Q | NA | NA | NA | NA | −0.28 | 0.36 | Yes | No |
| T583E | −0.62 | 0.10 | 0.01 | 0.09 | −0.72 | 0.28 | Yes | No |
| T583G | −0.17 | 0.05 | −0.35 | 0.05 | 0.16 | 0.06 | Yes | No |
| T583L | −0.09 | 0.06 | −0.72 | 0.07 | −0.24 | 0.22 | No | No |
| T583K | NA | NA | NA | NA | −0.15 | 0.44 | Yes | No |
| T583M | −0.72 | 0.13 | −0.89 | 0.14 | −0.12 | 0.32 | No | No |
| T583F | −0.41 | 0.13 | −0.83 | 0.15 | −0.13 | 0.36 | No | No |
| T583P | −0.14 | 0.08 | −0.64 | 0.08 | −0.37 | 0.14 | No | No |
| T583S | 0.18 | 0.05 | 0.11 | 0.05 | −0.34 | 0.07 | Yes | No |
| T583W | −0.31 | 0.07 | −0.54 | 0.08 | −0.09 | 0.08 | No | No |
| T583V | 0.01 | 0.06 | −0.05 | 0.06 | 0.15 | 0.22 | Yes | No |
| E584H | 0.09 | 0.07 | 0.22 | 0.07 | 0.17 | 0.14 | Yes | Yes |
| E584V | 0.10 | 0.03 | 0.06 | 0.03 | 0.12 | 0.04 | Yes | Yes |
| E584A | −0.01 | 0.03 | 0.09 | 0.03 | 0.10 | 0.06 | Yes | No |
| E584R | −0.23 | 0.03 | −0.12 | 0.03 | −0.10 | 0.05 | No | No |
| E584N | −0.50 | 0.09 | −0.38 | 0.08 | −0.11 | 0.20 | No | No |
| E584D | 0.46 | 0.04 | 0.51 | 0.04 | −0.02 | 0.08 | Yes | No |
| E584C | −0.03 | 0.05 | 0.09 | 0.05 | 0.13 | 0.07 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| E584Q | 0.09 | 0.07 | −0.88 | 0.08 | −0.09 | 0.10 | Yes | No |
| E584G | −0.02 | 0.02 | 0.06 | 0.02 | 0.16 | 0.04 | Yes | No |
| E584I | 0.32 | 0.07 | −0.34 | 0.08 | −0.03 | 0.20 | Yes | No |
| E584L | −0.27 | 0.04 | 0.00 | 0.04 | −0.06 | 0.10 | No | No |
| E584K | −0.29 | 0.06 | −0.78 | 0.07 | 0.39 | 0.09 | Yes | No |
| E584M | −0.17 | 0.07 | −0.68 | 0.08 | 0.34 | 0.13 | Yes | No |
| E584F | −0.11 | 0.08 | −0.41 | 0.09 | 0.27 | 0.19 | Yes | No |
| E584P | 0.12 | 0.05 | −0.13 | 0.06 | −0.24 | 0.17 | Yes | No |
| E584S | −0.44 | 0.04 | 0.09 | 0.04 | 0.26 | 0.09 | Yes | No |
| E584* | −1.22 | 0.09 | −1.26 | 0.08 | −1.15 | 0.13 | No | No |
| E584T | −0.03 | 0.05 | −0.03 | 0.05 | 0.17 | 0.15 | Yes | No |
| E584W | −0.73 | 0.06 | −0.52 | 0.05 | −0.32 | 0.07 | No | No |
| E584Y | −0.13 | 0.07 | 0.55 | 0.06 | 0.05 | 0.25 | Yes | No |
| K585R | 0.07 | 0.03 | 0.32 | 0.03 | 0.06 | 0.05 | Yes | Yes |
| K585F | 0.51 | 0.09 | 0.04 | 0.09 | 0.61 | 0.36 | Yes | Yes |
| K585A | 0.21 | 0.04 | −0.23 | 0.05 | 0.16 | 0.13 | Yes | No |
| K585N | −0.13 | 0.09 | 0.18 | 0.08 | −0.67 | 0.12 | Yes | No |
| K585D | −0.05 | 0.07 | −0.08 | 0.07 | −0.05 | 0.23 | No | No |
| K585C | −0.25 | 0.07 | −0.61 | 0.08 | −0.11 | 0.29 | No | No |
| K585Q | 0.07 | 0.06 | 0.41 | 0.06 | −0.09 | 0.08 | Yes | No |
| K585E | −0.33 | 0.05 | −0.44 | 0.05 | 0.10 | 0.12 | Yes | No |
| K585G | −0.18 | 0.03 | −0.04 | 0.03 | 0.16 | 0.04 | Yes | No |
| K585H | 0.12 | 0.11 | −0.60 | 0.13 | 0.28 | 0.14 | Yes | No |
| K585I | −1.45 | 0.14 | 0.35 | 0.08 | 0.11 | 0.25 | Yes | No |
| K585L | −0.10 | 0.04 | −0.06 | 0.04 | 0.27 | 0.13 | Yes | No |
| K585M | −0.25 | 0.07 | −0.05 | 0.06 | 0.21 | 0.17 | Yes | No |
| K585P | 0.20 | 0.06 | −0.04 | 0.07 | 0.15 | 0.21 | Yes | No |
| K585S | −0.17 | 0.05 | 0.24 | 0.04 | 0.20 | 0.11 | Yes | No |
| K585* | −0.91 | 0.07 | −0.60 | 0.06 | −0.61 | 0.11 | No | No |
| K585T | 0.08 | 0.05 | −0.30 | 0.05 | 0.05 | 0.07 | Yes | No |
| K585W | −0.21 | 0.05 | −0.15 | 0.05 | 0.18 | 0.16 | Yes | No |
| K585Y | 0.18 | 0.10 | −0.92 | 0.13 | 0.07 | 0.40 | Yes | No |
| K585V | −0.16 | 0.04 | −0.68 | 0.04 | 0.37 | 0.06 | Yes | No |
| T586A | −0.30 | 0.05 | −0.02 | 0.04 | −0.01 | 0.11 | No | No |
| T586R | −0.56 | 0.05 | −0.06 | 0.04 | −0.20 | 0.14 | No | No |
| T586N | −0.07 | 0.05 | 0.15 | 0.05 | −0.02 | 0.07 | Yes | No |
| T586D | −0.41 | 0.12 | 1.10 | 0.09 | 0.41 | 0.30 | Yes | No |
| T586C | −0.60 | 0.11 | −0.45 | 0.10 | 0.10 | 0.29 | Yes | No |
| T586Q | −0.65 | 0.14 | 0.28 | 0.11 | NA | NA | Yes | No |
| T586E | −0.29 | 0.09 | 0.04 | 0.08 | 0.16 | 0.37 | Yes | No |
| T586G | −0.21 | 0.04 | 0.22 | 0.03 | −0.07 | 0.09 | Yes | No |
| T586I | −0.77 | 0.11 | 0.90 | 0.07 | −0.48 | 0.19 | Yes | No |
| T586L | −0.06 | 0.06 | −0.85 | 0.07 | 0.01 | 0.18 | Yes | No |
| T586K | −0.06 | 0.12 | 0.80 | 0.10 | −0.12 | 0.13 | Yes | No |
| T586M | −0.62 | 0.11 | −1.06 | 0.13 | 0.22 | 0.34 | Yes | No |
| T586F | 0.21 | 0.13 | −0.21 | 0.14 | 0.02 | 0.54 | Yes | No |
| T586P | 0.38 | 0.06 | −0.09 | 0.06 | 0.22 | 0.12 | Yes | No |
| T586S | −0.22 | 0.05 | −0.08 | 0.05 | 0.01 | 0.08 | Yes | No |
| T586W | −0.48 | 0.07 | −0.61 | 0.07 | −0.29 | 0.24 | No | No |
| T586Y | NA | NA | NA | NA | 0.24 | 0.26 | Yes | No |
| T586V | −0.97 | 0.07 | −0.13 | 0.05 | 0.13 | 0.17 | Yes | No |
| S587A | NA | NA | NA | NA | 0.45 | 0.32 | Yes | No |
| S587R | 0.15 | 0.08 | −0.61 | 0.09 | −0.34 | 0.15 | Yes | No |
| S587N | −0.30 | 0.13 | −0.31 | 0.13 | −0.26 | 0.18 | No | No |
| S587C | 0.01 | 0.15 | 0.00 | 0.14 | NA | NA | Yes | No |
| S587E | 0.33 | 0.16 | −0.40 | 0.19 | NA | NA | Yes | No |
| S587G | −0.32 | 0.06 | −0.81 | 0.07 | −0.21 | 0.06 | No | No |
| S587L | 0.21 | 0.14 | 0.27 | 0.13 | NA | NA | Yes | No |
| S587T | 0.80 | 0.11 | −0.41 | 0.14 | −0.13 | 0.23 | Yes | No |
| S587V | 0.20 | 0.11 | −0.25 | 0.12 | −0.04 | 0.12 | Yes | No |
| E588A | −0.01 | 0.05 | 0.25 | 0.05 | 0.17 | 0.10 | Yes | No |
| E588R | −0.39 | 0.05 | −0.61 | 0.05 | −0.31 | 0.07 | No | No |
| E588D | 0.00 | 0.08 | −0.12 | 0.08 | −0.55 | 0.13 | Yes | No |
| E588C | −0.64 | 0.11 | −0.35 | 0.10 | 0.00 | 0.10 | No | No |
| E588Q | 0.11 | 0.09 | −0.25 | 0.09 | −0.08 | 0.13 | Yes | No |
| E588G | −0.16 | 0.04 | −0.19 | 0.04 | −0.34 | 0.04 | No | No |
| E588H | −0.35 | 0.17 | −0.26 | 0.16 | NA | NA | Yes | No |
| E588L | −0.31 | 0.07 | −0.29 | 0.07 | 0.41 | 0.12 | Yes | No |
| E588K | 0.18 | 0.07 | 0.13 | 0.07 | −0.25 | 0.15 | Yes | No |
| E588M | −0.50 | 0.12 | −0.10 | 0.11 | 0.54 | 0.12 | Yes | No |
| E588F | −0.23 | 0.15 | 0.13 | 0.14 | NA | NA | Yes | No |
| E588P | −0.04 | 0.10 | 0.06 | 0.09 | 0.52 | 0.19 | Yes | No |
| E588S | −0.03 | 0.07 | −0.34 | 0.08 | −0.47 | 0.08 | No | No |
| E588* | −1.05 | 0.11 | −1.06 | 0.11 | −1.02 | 0.15 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| E588T | 0.32 | 0.09 | −1.53 | 0.15 | NA | NA | Yes | No |
| E588W | −0.02 | 0.07 | 0.03 | 0.07 | −0.01 | 0.19 | Yes | No |
| E588Y | −0.11 | 0.17 | 0.93 | 0.14 | NA | NA | Yes | No |
| E588V | −0.70 | 0.06 | −0.19 | 0.05 | 0.07 | 0.08 | Yes | No |
| G589A | −0.44 | 0.05 | −0.09 | 0.04 | −0.52 | 0.14 | No | No |
| G589R | −0.21 | 0.04 | −0.73 | 0.04 | −0.69 | 0.07 | No | No |
| G589D | −0.29 | 0.08 | −0.88 | 0.10 | −0.70 | 0.17 | No | No |
| G589C | −0.14 | 0.04 | −0.12 | 0.04 | −0.59 | 0.07 | No | No |
| G589Q | NA | NA | NA | NA | −0.13 | 0.27 | Yes | No |
| G589E | −0.39 | 0.06 | −1.47 | 0.08 | −0.59 | 0.24 | No | No |
| G589L | 0.07 | 0.06 | −1.02 | 0.08 | −1.07 | 0.20 | Yes | No |
| G589M | −0.45 | 0.12 | −1.01 | 0.14 | NA | NA | Yes | No |
| G589P | −0.34 | 0.08 | −2.17 | 0.15 | −1.08 | 0.12 | No | No |
| G589S | −0.13 | 0.04 | −0.30 | 0.04 | −0.54 | 0.10 | No | No |
| G589T | −0.52 | 0.11 | −0.51 | 0.10 | −1.12 | 0.28 | No | No |
| G589W | −0.62 | 0.06 | −0.77 | 0.07 | −0.26 | 0.13 | No | No |
| G589Y | NA | NA | NA | NA | −0.01 | 0.41 | Yes | No |
| G589V | −0.65 | 0.05 | −0.97 | 0.06 | −0.22 | 0.13 | No | No |
| F590A | −0.43 | 0.05 | −1.38 | 0.07 | −1.07 | 0.15 | No | No |
| F590R | −0.22 | 0.05 | −0.83 | 0.05 | −0.62 | 0.15 | No | No |
| F590N | −0.95 | 0.17 | −0.65 | 0.15 | NA | NA | Yes | No |
| F590C | −0.49 | 0.08 | −0.73 | 0.08 | −1.06 | 0.20 | No | No |
| F590E | −1.00 | 0.09 | −1.26 | 0.10 | −0.44 | 0.26 | No | No |
| F590G | −1.05 | 0.04 | −1.44 | 0.05 | −1.47 | 0.09 | No | No |
| F590I | 0.01 | 0.09 | 0.10 | 0.08 | NA | NA | Yes | No |
| F590L | −0.02 | 0.04 | −0.21 | 0.04 | −0.51 | 0.06 | No | No |
| F590M | −0.27 | 0.12 | −0.41 | 0.12 | NA | NA | Yes | No |
| F590P | −1.08 | 0.10 | −1.31 | 0.10 | −1.37 | 0.17 | No | No |
| F590S | −0.03 | 0.05 | −0.29 | 0.05 | −0.61 | 0.07 | No | No |
| F590T | −1.50 | 0.15 | −1.08 | 0.12 | NA | NA | Yes | No |
| F590W | 0.04 | 0.07 | −0.11 | 0.07 | −0.87 | 0.26 | Yes | No |
| F590Y | 0.07 | 0.06 | −0.18 | 0.07 | −0.19 | 0.17 | Yes | No |
| F590V | −1.03 | 0.06 | −0.97 | 0.06 | −0.98 | 0.14 | No | No |
| D591A | 0.20 | 0.04 | 0.07 | 0.04 | −0.54 | 0.05 | Yes | No |
| D591R | −0.94 | 0.05 | −1.06 | 0.05 | −0.45 | 0.13 | No | No |
| D591N | −0.49 | 0.10 | −0.61 | 0.10 | −0.54 | 0.14 | No | No |
| D591C | −0.66 | 0.10 | −0.68 | 0.09 | −0.47 | 0.23 | No | No |
| D591Q | −0.34 | 0.10 | 0.11 | 0.09 | −0.15 | 0.38 | Yes | No |
| D591E | −0.43 | 0.05 | −0.39 | 0.05 | −0.84 | 0.14 | No | No |
| D591G | −0.62 | 0.03 | −0.81 | 0.03 | −0.59 | 0.03 | No | No |
| D591H | −1.19 | 0.16 | −0.84 | 0.14 | NA | NA | Yes | No |
| D591L | −0.17 | 0.06 | −0.59 | 0.07 | −0.99 | 0.20 | No | No |
| D591K | −0.51 | 0.12 | −0.27 | 0.11 | NA | NA | Yes | No |
| D591M | −0.90 | 0.12 | −0.93 | 0.12 | −0.36 | 0.27 | No | No |
| D591S | −0.69 | 0.07 | −1.41 | 0.09 | −0.67 | 0.17 | No | No |
| D591T | −0.15 | 0.08 | −0.93 | 0.10 | −1.04 | 0.23 | No | No |
| D591W | −1.02 | 0.08 | −0.91 | 0.07 | −0.42 | 0.16 | No | No |
| D591Y | 0.08 | 0.10 | −0.62 | 0.12 | −0.50 | 0.17 | Yes | No |
| D591V | −0.76 | 0.05 | −1.11 | 0.05 | −1.12 | 0.11 | No | No |
| K592A | −1.60 | 0.09 | −0.60 | 0.06 | −1.42 | 0.15 | No | No |
| K592R | −0.98 | 0.05 | −0.77 | 0.04 | −1.03 | 0.05 | No | No |
| K592N | −0.12 | 0.10 | 0.07 | 0.10 | −0.91 | 0.19 | Yes | No |
| K592Q | −0.52 | 0.07 | −0.77 | 0.08 | −0.30 | 0.10 | No | No |
| K592E | −0.52 | 0.07 | −0.76 | 0.07 | −1.22 | 0.10 | No | No |
| K592G | −1.76 | 0.06 | −1.45 | 0.05 | −1.64 | 0.08 | No | No |
| K592L | −1.72 | 0.08 | −1.52 | 0.08 | −1.24 | 0.13 | No | No |
| K592M | −0.70 | 0.07 | −0.58 | 0.07 | −0.68 | 0.07 | No | No |
| K592P | −1.70 | 0.14 | −1.63 | 0.13 | NA | NA | Yes | No |
| K592S | −1.67 | 0.10 | −1.56 | 0.10 | NA | NA | Yes | No |
| K592* | 0.00 | 0.08 | −1.63 | 0.13 | −0.91 | 0.18 | Yes | No |
| K592T | −1.38 | 0.11 | −0.98 | 0.09 | NA | NA | Yes | No |
| K592W | −1.60 | 0.10 | −1.14 | 0.08 | −0.21 | 0.20 | No | No |
| K592V | −1.60 | 0.06 | −1.14 | 0.05 | −1.90 | 0.08 | No | No |
| M593A | −1.94 | 0.07 | −1.00 | 0.05 | −1.73 | 0.06 | No | No |
| M593R | −0.79 | 0.03 | −0.81 | 0.03 | −0.81 | 0.03 | No | No |
| M593N | −1.58 | 0.13 | −1.89 | 0.15 | NA | NA | Yes | No |
| M593D | −2.12 | 0.13 | −1.32 | 0.09 | −1.77 | 0.18 | No | No |
| M593C | −0.95 | 0.07 | −0.04 | 0.06 | −1.27 | 0.10 | No | No |
| M593Q | NA | NA | NA | NA | −0.83 | 0.19 | Yes | No |
| M593E | −2.30 | 0.10 | −2.14 | 0.09 | −1.55 | 0.14 | No | No |
| M593G | −1.83 | 0.04 | −1.88 | 0.04 | −1.09 | 0.07 | No | No |
| M593I | −0.83 | 0.07 | −1.05 | 0.08 | −1.17 | 0.12 | No | No |
| M593L | −0.10 | 0.03 | −0.33 | 0.03 | −0.52 | 0.06 | No | No |
| M593K | −1.64 | 0.09 | −1.56 | 0.08 | −1.09 | 0.05 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| M593F | −1.98 | 0.12 | −0.83 | 0.08 | −1.61 | 0.12 | No | No |
| M593P | −1.56 | 0.10 | −2.23 | 0.12 | −0.38 | 0.12 | No | No |
| M593S | −1.58 | 0.06 | −1.88 | 0.07 | −1.33 | 0.11 | No | No |
| M593* | −2.27 | 0.12 | −2.28 | 0.12 | −1.55 | 0.18 | No | No |
| M593T | −1.01 | 0.06 | −0.79 | 0.05 | −0.64 | 0.10 | No | No |
| M593W | −0.92 | 0.05 | −1.57 | 0.07 | −2.41 | 0.16 | No | No |
| M593V | −0.56 | 0.03 | −1.41 | 0.04 | −1.07 | 0.07 | No | No |
| Y594A | −0.40 | 0.04 | −1.29 | 0.05 | −1.34 | 0.10 | No | No |
| Y594R | −0.02 | 0.03 | −0.18 | 0.03 | −1.14 | 0.08 | No | No |
| Y594N | −1.08 | 0.10 | −0.80 | 0.08 | −0.62 | 0.15 | No | No |
| Y594D | −1.17 | 0.07 | −1.36 | 0.07 | −1.43 | 0.13 | No | No |
| Y594C | −0.47 | 0.06 | −0.08 | 0.06 | −1.45 | 0.10 | No | No |
| Y594Q | −1.06 | 0.08 | −0.26 | 0.06 | −1.14 | 0.12 | No | No |
| Y594E | −0.42 | 0.04 | −0.82 | 0.05 | −2.58 | 0.11 | No | No |
| Y594G | −1.21 | 0.03 | −1.58 | 0.03 | −1.51 | 0.04 | No | No |
| Y594H | 0.04 | 0.07 | −0.11 | 0.07 | −0.42 | 0.12 | Yes | No |
| Y594I | −0.73 | 0.10 | −0.78 | 0.10 | −0.74 | 0.27 | No | No |
| Y594L | −0.88 | 0.05 | −0.67 | 0.04 | −1.45 | 0.10 | No | No |
| Y594K | −0.40 | 0.06 | −0.88 | 0.07 | −1.41 | 0.17 | No | No |
| Y594M | 0.05 | 0.06 | −0.76 | 0.07 | −1.47 | 0.18 | Yes | No |
| Y594F | −0.18 | 0.07 | −0.07 | 0.06 | −0.45 | 0.14 | No | No |
| Y594S | −1.00 | 0.05 | −0.88 | 0.05 | −1.40 | 0.06 | No | No |
| Y594* | −1.41 | 0.08 | −0.73 | 0.06 | −1.67 | 0.13 | No | No |
| Y594T | −1.66 | 0.09 | −1.71 | 0.09 | −1.37 | 0.15 | No | No |
| Y594W | −0.33 | 0.04 | −0.93 | 0.05 | −1.06 | 0.10 | No | No |
| Y594V | −0.40 | 0.04 | −0.47 | 0.04 | −0.96 | 0.08 | No | No |
| Y595A | −1.63 | 0.05 | −1.08 | 0.04 | −2.32 | 0.10 | No | No |
| Y595R | −1.29 | 0.04 | −1.66 | 0.05 | −2.00 | 0.06 | No | No |
| Y595N | −1.61 | 0.14 | −0.78 | 0.10 | −0.80 | 0.19 | No | No |
| Y595D | −1.27 | 0.09 | −1.50 | 0.09 | −1.84 | 0.06 | No | No |
| Y595C | −0.14 | 0.05 | −0.50 | 0.05 | −1.06 | 0.11 | No | No |
| Y595Q | −1.71 | 0.10 | −1.18 | 0.08 | −1.13 | 0.22 | No | No |
| Y595E | −2.05 | 0.08 | −2.21 | 0.08 | −2.32 | 0.03 | No | No |
| Y595G | −1.67 | 0.03 | −1.31 | 0.03 | −1.77 | 0.03 | No | No |
| Y595H | −0.86 | 0.09 | −0.57 | 0.08 | −0.77 | 0.13 | No | No |
| Y595I | −1.20 | 0.14 | −1.49 | 0.15 | NA | NA | Yes | No |
| Y595L | −0.09 | 0.04 | 0.08 | 0.04 | −0.83 | 0.12 | Yes | No |
| Y595K | −1.17 | 0.09 | −1.74 | 0.11 | NA | NA | Yes | No |
| Y595M | 0.24 | 0.06 | −0.10 | 0.07 | −0.34 | 0.19 | Yes | No |
| Y595F | −1.21 | 0.09 | −0.70 | 0.08 | −1.09 | 0.14 | No | No |
| Y595S | −1.31 | 0.05 | −1.19 | 0.05 | −1.64 | 0.09 | No | No |
| Y595* | −1.32 | 0.07 | −1.52 | 0.08 | −1.60 | 0.09 | No | No |
| Y595T | −0.27 | 0.05 | −0.81 | 0.06 | NA | NA | Yes | No |
| Y595W | −1.72 | 0.06 | −1.71 | 0.06 | −1.97 | 0.10 | No | No |
| Y595V | −0.32 | 0.03 | −0.74 | 0.04 | −2.00 | 0.06 | No | No |
| D596E | 0.04 | 0.04 | 0.24 | 0.04 | 0.69 | 0.05 | Yes | Yes |
| D596A | 0.07 | 0.03 | −0.18 | 0.04 | −0.99 | 0.09 | Yes | No |
| D596R | 0.01 | 0.03 | 0.07 | 0.03 | −0.20 | 0.04 | Yes | No |
| D596N | −0.12 | 0.08 | 0.29 | 0.08 | 0.39 | 0.15 | Yes | No |
| D596C | −0.01 | 0.07 | −0.24 | 0.07 | −0.55 | 0.06 | No | No |
| D596Q | −0.04 | 0.09 | 0.42 | 0.08 | 0.46 | 0.31 | Yes | No |
| D596G | −0.23 | 0.02 | −0.22 | 0.02 | −1.16 | 0.05 | No | No |
| D596H | 0.24 | 0.10 | −0.18 | 0.11 | 0.16 | 0.26 | Yes | No |
| D596L | −0.92 | 0.07 | −0.10 | 0.05 | −0.75 | 0.18 | No | No |
| D596K | 0.01 | 0.08 | 0.36 | 0.07 | −0.07 | 0.19 | Yes | No |
| D596M | 0.26 | 0.08 | 0.29 | 0.07 | −0.27 | 0.28 | Yes | No |
| D596F | 0.03 | 0.11 | −0.55 | 0.13 | 0.09 | 0.13 | Yes | No |
| D596P | NA | NA | NA | NA | −0.56 | 0.24 | Yes | No |
| D596S | −0.58 | 0.06 | −0.29 | 0.05 | 0.37 | 0.07 | Yes | No |
| D596* | −0.99 | 0.11 | −1.29 | 0.12 | NA | NA | Yes | No |
| D596T | −1.56 | 0.12 | 0.65 | 0.06 | −1.10 | 0.23 | Yes | No |
| D596W | −0.19 | 0.05 | 0.12 | 0.05 | −1.34 | 0.11 | Yes | No |
| D596Y | −0.55 | 0.09 | −0.32 | 0.08 | −0.27 | 0.16 | No | No |
| D596V | −0.06 | 0.03 | −0.22 | 0.03 | −1.39 | 0.08 | No | No |
| Y597A | −2.00 | 0.06 | −1.33 | 0.05 | −2.10 | 0.12 | No | No |
| Y597R | −2.18 | 0.05 | −2.13 | 0.05 | −2.18 | 0.04 | No | No |
| Y597N | −1.28 | 0.11 | −0.66 | 0.09 | −1.35 | 0.13 | No | No |
| Y597D | −0.30 | 0.03 | −0.28 | 0.03 | −0.34 | 0.04 | No | No |
| Y597C | −0.79 | 0.06 | −1.14 | 0.07 | −1.47 | 0.05 | No | No |
| Y597E | −2.33 | 0.09 | −2.41 | 0.09 | NA | NA | Yes | No |
| Y597G | −1.89 | 0.04 | −2.15 | 0.04 | −1.96 | 0.05 | No | No |
| Y597H | −0.45 | 0.07 | −0.25 | 0.06 | −0.71 | 0.10 | No | No |
| Y597I | −0.51 | 0.11 | −1.26 | 0.13 | NA | NA | Yes | No |
| Y597L | 0.24 | 0.04 | 0.32 | 0.04 | −0.31 | 0.09 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| Y597M | −0.11 | 0.07 | −1.15 | 0.10 | NA | NA | Yes | No |
| Y597F | −0.08 | 0.07 | −0.16 | 0.07 | 0.56 | 0.06 | Yes | No |
| Y597P | −2.03 | 0.11 | −2.30 | 0.11 | NA | NA | Yes | No |
| Y597S | −1.25 | 0.05 | −1.04 | 0.05 | −2.00 | 0.09 | No | No |
| Y597* | −0.94 | 0.06 | −0.96 | 0.06 | −2.02 | 0.13 | No | No |
| Y597T | −1.78 | 0.09 | −2.62 | 0.12 | −1.94 | 0.04 | No | No |
| Y597W | −1.16 | 0.05 | −1.33 | 0.05 | −2.30 | 0.08 | No | No |
| Y597V | −1.95 | 0.07 | −1.63 | 0.06 | −2.69 | 0.08 | No | No |
| F598A | −1.68 | 0.07 | −1.98 | 0.08 | −2.09 | 0.12 | No | No |
| F598R | −1.81 | 0.06 | −2.21 | 0.07 | −1.57 | 0.11 | No | No |
| F598C | −1.96 | 0.12 | −2.25 | 0.13 | −1.21 | 0.15 | No | No |
| F598G | −2.06 | 0.05 | −1.79 | 0.04 | −0.96 | 0.03 | No | No |
| F598I | −0.32 | 0.09 | −0.44 | 0.09 | −0.75 | 0.12 | No | No |
| F598L | −0.25 | 0.04 | −0.09 | 0.04 | −0.65 | 0.04 | No | No |
| F598M | −0.35 | 0.09 | −0.55 | 0.09 | −0.87 | 0.27 | No | No |
| F598P | NA | NA | NA | NA | −1.93 | 0.07 | Yes | No |
| F598S | −1.12 | 0.06 | −1.33 | 0.06 | −1.35 | 0.08 | No | No |
| F598W | −1.23 | 0.06 | −0.34 | 0.05 | −1.74 | 0.12 | No | No |
| F598Y | −0.52 | 0.09 | −0.44 | 0.09 | −0.60 | 0.15 | No | No |
| F598V | −1.37 | 0.06 | −1.39 | 0.05 | −2.25 | 0.09 | No | No |
| P599G | 0.84 | 0.04 | 0.83 | 0.04 | 1.01 | 0.05 | Yes | Yes |
| P599A | −1.03 | 0.07 | −0.85 | 0.06 | −1.42 | 0.11 | No | No |
| P599R | −1.89 | 0.09 | −1.20 | 0.06 | −2.08 | 0.14 | No | No |
| P599N | −0.66 | 0.16 | −0.33 | 0.14 | NA | NA | Yes | No |
| P599E | −2.04 | 0.15 | −2.07 | 0.15 | NA | NA | Yes | No |
| P599H | −1.01 | 0.14 | −0.99 | 0.14 | NA | NA | Yes | No |
| P599L | −1.56 | 0.09 | −1.36 | 0.08 | −1.46 | 0.11 | No | No |
| P599S | −0.09 | 0.03 | −0.10 | 0.03 | −0.56 | 0.04 | No | No |
| P599* | −1.14 | 0.13 | −1.42 | 0.14 | NA | NA | Yes | No |
| P599T | −0.42 | 0.07 | −0.95 | 0.08 | −1.37 | 0.14 | No | No |
| P599V | −1.88 | 0.12 | −1.85 | 0.11 | −1.81 | 0.14 | No | No |
| D600A | 0.43 | 0.06 | −0.31 | 0.07 | 0.68 | 0.14 | Yes | No |
| D600R | −0.88 | 0.07 | −0.40 | 0.06 | −1.67 | 0.19 | No | No |
| D600N | −0.03 | 0.07 | −0.16 | 0.07 | 0.67 | 0.14 | Yes | No |
| D600C | NA | NA | NA | NA | −0.32 | 0.48 | Yes | No |
| D600Q | −0.37 | 0.15 | −0.01 | 0.13 | NA | NA | Yes | No |
| D600E | −0.44 | 0.07 | −0.46 | 0.07 | −0.95 | 0.22 | No | No |
| D600G | −0.19 | 0.04 | −0.33 | 0.04 | 1.07 | 0.05 | Yes | No |
| D600H | −0.08 | 0.13 | −0.54 | 0.14 | NA | NA | Yes | No |
| D600L | −1.26 | 0.13 | −1.19 | 0.12 | −0.50 | 0.29 | No | No |
| D600P | −0.14 | 0.11 | −1.46 | 0.16 | 0.47 | 0.45 | Yes | No |
| D600S | 0.86 | 0.07 | −0.03 | 0.08 | 0.74 | 0.14 | Yes | No |
| D600T | −1.42 | 0.15 | −0.70 | 0.12 | 0.43 | 0.29 | Yes | No |
| D600W | −0.67 | 0.11 | −0.51 | 0.10 | NA | NA | Yes | No |
| D600Y | −0.29 | 0.13 | −0.19 | 0.12 | NA | NA | Yes | No |
| D600V | −0.05 | 0.06 | −0.23 | 0.06 | −0.56 | 0.13 | No | No |
| A601R | −1.65 | 0.07 | −1.62 | 0.07 | NA | NA | Yes | No |
| A601D | −1.38 | 0.13 | −1.10 | 0.11 | NA | NA | Yes | No |
| A601C | 0.26 | 0.08 | 0.26 | 0.08 | −0.25 | 0.24 | Yes | No |
| A601G | −1.05 | 0.04 | −0.63 | 0.04 | −1.44 | 0.04 | No | No |
| A601L | −2.16 | 0.13 | −1.44 | 0.09 | NA | NA | Yes | No |
| A601P | −1.40 | 0.13 | −1.20 | 0.11 | NA | NA | Yes | No |
| A601S | −0.60 | 0.06 | 0.23 | 0.04 | −0.52 | 0.08 | Yes | No |
| A601T | −0.84 | 0.08 | −0.53 | 0.07 | −0.99 | 0.12 | No | No |
| A601W | −1.89 | 0.12 | −1.84 | 0.11 | NA | NA | Yes | No |
| A601V | −0.48 | 0.05 | −0.23 | 0.04 | −0.77 | 0.06 | No | No |
| A602C | 0.64 | 0.09 | 0.61 | 0.09 | 0.73 | 0.28 | Yes | Yes |
| A602R | −0.59 | 0.07 | −0.97 | 0.08 | NA | NA | Yes | No |
| A602D | 0.04 | 0.04 | −0.09 | 0.04 | −0.40 | 0.05 | Yes | No |
| A602G | −0.52 | 0.05 | −0.56 | 0.05 | −1.62 | 0.06 | No | No |
| A602H | NA | NA | NA | NA | 0.37 | 0.35 | Yes | No |
| A602L | −1.97 | 0.14 | −1.06 | 0.10 | NA | NA | Yes | No |
| A602P | −0.80 | 0.09 | −0.42 | 0.08 | −0.71 | 0.15 | No | No |
| A602S | −0.38 | 0.07 | −0.14 | 0.06 | −0.73 | 0.16 | No | No |
| A602T | −0.28 | 0.06 | −0.03 | 0.06 | −0.51 | 0.11 | No | No |
| A602W | NA | NA | NA | NA | −0.89 | 0.37 | Yes | No |
| A602V | −0.77 | 0.06 | −0.66 | 0.05 | −1.41 | 0.10 | No | No |
| K603A | −1.34 | 0.07 | −1.59 | 0.07 | −1.76 | 0.05 | No | No |
| K603R | −0.56 | 0.04 | −0.37 | 0.03 | −0.46 | 0.04 | No | No |
| K603N | −1.59 | 0.16 | −1.11 | 0.13 | NA | NA | Yes | No |
| K603C | −1.03 | 0.10 | −1.23 | 0.10 | NA | NA | Yes | No |
| K603Q | −1.30 | 0.11 | −1.57 | 0.12 | NA | NA | Yes | No |
| K603E | −1.40 | 0.07 | −0.68 | 0.05 | −1.60 | 0.10 | No | No |
| K603G | −1.88 | 0.05 | −1.70 | 0.04 | −1.97 | 0.08 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| K603H | NA | NA | NA | NA | −0.51 | 0.41 | Yes | No |
| K603L | −0.77 | 0.06 | −0.60 | 0.06 | −1.63 | 0.14 | No | No |
| K603M | 0.00 | 0.06 | −0.57 | 0.07 | −1.02 | 0.11 | No | No |
| K603P | −1.70 | 0.12 | −1.06 | 0.09 | NA | NA | Yes | No |
| K603S | NA | NA | NA | NA | −2.06 | 0.05 | Yes | No |
| K603* | −1.20 | 0.09 | −1.66 | 0.11 | −1.37 | 0.16 | No | No |
| K603T | −1.11 | 0.08 | −1.15 | 0.08 | −1.13 | 0.13 | No | No |
| K603W | −2.79 | 0.14 | −1.74 | 0.09 | −1.45 | 0.14 | No | No |
| K603V | −1.72 | 0.07 | −1.54 | 0.06 | −2.40 | 0.07 | No | No |
| M604A | −2.19 | 0.15 | −1.92 | 0.13 | NA | NA | Yes | No |
| M604R | −0.96 | 0.06 | −1.76 | 0.08 | −2.02 | 0.13 | No | No |
| M604G | −2.12 | 0.08 | −0.82 | 0.05 | −1.81 | 0.12 | No | No |
| M604I | −0.58 | 0.10 | −0.71 | 0.10 | −0.51 | 0.15 | No | No |
| M604L | −0.74 | 0.06 | −0.50 | 0.06 | −0.25 | 0.06 | No | No |
| M604K | −1.08 | 0.15 | −0.78 | 0.13 | NA | NA | Yes | No |
| M604T | −0.14 | 0.06 | 0.01 | 0.06 | −0.44 | 0.09 | Yes | No |
| M604W | −1.97 | 0.14 | −2.03 | 0.14 | NA | NA | Yes | No |
| M604V | −1.38 | 0.08 | −1.32 | 0.07 | −1.38 | 0.09 | No | No |
| I605A | −1.32 | 0.09 | −1.04 | 0.08 | NA | NA | Yes | No |
| I605R | −2.07 | 0.09 | −2.36 | 0.10 | −2.12 | 0.15 | No | No |
| I605N | −0.93 | 0.10 | −0.19 | 0.08 | −0.76 | 0.16 | No | No |
| I605C | 0.20 | 0.09 | −0.98 | 0.13 | NA | NA | Yes | No |
| I605G | −1.69 | 0.07 | −1.41 | 0.06 | −2.04 | 0.14 | No | No |
| I605L | −0.93 | 0.07 | −0.25 | 0.06 | −1.49 | 0.14 | No | No |
| I605M | −1.09 | 0.09 | −0.86 | 0.08 | −1.44 | 0.15 | No | No |
| I605F | −0.50 | 0.11 | −0.52 | 0.10 | NA | NA | Yes | No |
| I605S | −1.91 | 0.11 | −1.82 | 0.10 | −1.55 | 0.10 | No | No |
| I605T | −0.45 | 0.07 | −0.67 | 0.07 | −1.09 | 0.12 | No | No |
| I605V | 0.13 | 0.05 | −0.04 | 0.05 | −0.33 | 0.11 | Yes | No |
| I605A | −1.42 | 0.10 | −0.82 | 0.08 | NA | NA | Yes | No |
| I605R | −2.12 | 0.09 | −2.15 | 0.10 | −1.82 | 0.16 | No | No |
| I605N | 0.04 | 0.06 | 0.36 | 0.06 | −0.41 | 0.09 | Yes | No |
| I605D | −1.00 | 0.09 | −0.60 | 0.08 | −0.72 | 0.14 | No | No |
| I605C | 0.10 | 0.10 | −0.82 | 0.13 | NA | NA | Yes | No |
| I605G | −1.69 | 0.07 | −1.23 | 0.06 | −1.96 | 0.13 | No | No |
| I605L | −0.10 | 0.03 | 0.14 | 0.03 | −1.00 | 0.08 | Yes | No |
| I605M | −0.89 | 0.09 | −0.63 | 0.08 | −1.25 | 0.21 | No | No |
| I605F | −0.55 | 0.10 | −0.33 | 0.09 | NA | NA | Yes | No |
| I605S | −0.22 | 0.04 | 0.10 | 0.04 | −1.29 | 0.08 | Yes | No |
| I605T | −0.02 | 0.04 | 0.21 | 0.04 | −0.53 | 0.07 | Yes | No |
| I605V | 0.19 | 0.05 | 0.25 | 0.05 | −0.06 | 0.10 | Yes | No |
| P606A | −1.59 | 0.10 | −2.27 | 0.12 | −1.25 | 0.17 | No | No |
| P606R | −1.77 | 0.08 | −2.62 | 0.12 | −1.94 | 0.15 | No | No |
| P606G | −1.63 | 0.07 | −2.12 | 0.08 | −1.89 | 0.14 | No | No |
| P606H | −0.89 | 0.13 | −0.93 | 0.13 | NA | NA | Yes | No |
| P606L | −0.77 | 0.07 | −1.12 | 0.08 | −1.30 | 0.15 | No | No |
| P606S | −1.42 | 0.10 | −1.22 | 0.09 | −1.16 | 0.14 | No | No |
| P606T | −0.06 | 0.06 | −0.63 | 0.07 | −0.40 | 0.08 | No | No |
| P606W | −0.88 | 0.11 | −1.05 | 0.11 | NA | NA | Yes | No |
| P606V | NA | NA | NA | NA | −1.59 | 0.24 | Yes | No |
| P606A | −1.59 | 0.10 | −2.27 | 0.14 | −1.33 | 0.19 | No | No |
| P606R | −1.77 | 0.09 | −1.59 | 0.08 | −1.76 | 0.15 | No | No |
| P606Q | NA | NA | NA | NA | −0.43 | 0.12 | Yes | No |
| P606G | −1.73 | 0.08 | −2.00 | 0.09 | −1.79 | 0.16 | No | No |
| P606H | 0.13 | 0.07 | 0.17 | 0.07 | −0.14 | 0.04 | Yes | No |
| P606L | −0.98 | 0.08 | −1.23 | 0.09 | −1.00 | 0.16 | No | No |
| P606S | −1.64 | 0.12 | −1.35 | 0.11 | −1.37 | 0.17 | No | No |
| P606T | −0.10 | 0.07 | −0.63 | 0.08 | −0.65 | 0.11 | No | No |
| P606W | −1.06 | 0.12 | −0.93 | 0.11 | NA | NA | Yes | No |
| P606V | NA | NA | NA | NA | −1.33 | 0.27 | Yes | No |
| K607A | −1.61 | 0.05 | −1.70 | 0.06 | −2.05 | 0.10 | No | No |
| K607R | −1.65 | 0.04 | −1.32 | 0.03 | −2.05 | 0.03 | No | No |
| K607N | −0.51 | 0.07 | −0.19 | 0.07 | NA | NA | Yes | No |
| K607D | −2.48 | 0.14 | −1.83 | 0.11 | NA | NA | Yes | No |
| K607C | −1.09 | 0.07 | −1.20 | 0.08 | NA | NA | Yes | No |
| K607Q | −1.77 | 0.09 | −1.64 | 0.09 | −1.87 | 0.13 | No | No |
| K607E | −1.93 | 0.06 | −1.40 | 0.05 | −1.61 | 0.07 | No | No |
| K607G | −1.81 | 0.03 | −1.60 | 0.03 | −1.79 | 0.03 | No | No |
| K607H | −1.16 | 0.12 | −0.39 | 0.10 | NA | NA | Yes | No |
| K607L | −1.08 | 0.05 | −1.66 | 0.06 | −1.63 | 0.08 | No | No |
| K607M | −0.42 | 0.06 | −1.47 | 0.08 | −0.97 | 0.05 | No | No |
| K607F | −1.55 | 0.12 | −1.20 | 0.11 | NA | NA | Yes | No |
| K607P | NA | NA | NA | NA | −1.84 | 0.14 | Yes | No |
| K607S | −1.89 | 0.06 | −1.43 | 0.06 | −1.53 | 0.04 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| K607* | −1.44 | 0.07 | −0.97 | 0.06 | −1.20 | 0.14 | No | No |
| K607T | −2.23 | 0.09 | −1.26 | 0.06 | −1.98 | 0.11 | No | No |
| K607W | −1.92 | 0.06 | −1.88 | 0.06 | −1.81 | 0.10 | No | No |
| K607V | −1.80 | 0.05 | −1.85 | 0.06 | −1.86 | 0.03 | No | No |
| C608A | −1.60 | 0.09 | −1.32 | 0.08 | −1.81 | 0.15 | No | No |
| C608R | −0.90 | 0.04 | −0.72 | 0.04 | −1.23 | 0.09 | No | No |
| C608E | −1.06 | 0.09 | −1.27 | 0.10 | NA | NA | Yes | No |
| C608G | −1.44 | 0.05 | −0.58 | 0.04 | −1.66 | 0.09 | No | No |
| C608L | −1.11 | 0.08 | −0.49 | 0.07 | NA | NA | Yes | No |
| C608F | −1.13 | 0.12 | −0.91 | 0.12 | NA | NA | Yes | No |
| C608P | −1.62 | 0.14 | −1.13 | 0.12 | NA | NA | Yes | No |
| C608S | −0.62 | 0.05 | −0.49 | 0.05 | −1.56 | 0.12 | No | No |
| C608* | −1.61 | 0.13 | −0.66 | 0.10 | NA | NA | Yes | No |
| C608W | −1.58 | 0.09 | −1.31 | 0.08 | NA | NA | Yes | No |
| C608Y | −0.27 | 0.06 | −0.09 | 0.06 | −0.65 | 0.15 | No | No |
| C608V | −1.32 | 0.07 | −2.23 | 0.11 | NA | NA | Yes | No |
| S609A | 0.10 | 0.07 | 0.21 | 0.07 | −0.16 | 0.22 | Yes | No |
| S609R | −0.60 | 0.05 | −0.45 | 0.05 | −1.32 | 0.06 | No | No |
| S609N | −1.18 | 0.12 | −0.49 | 0.10 | NA | NA | Yes | No |
| S609C | −0.69 | 0.12 | 0.21 | 0.09 | −0.27 | 0.25 | Yes | No |
| S609G | 0.00 | 0.04 | −0.27 | 0.04 | −0.17 | 0.10 | No | No |
| S609I | −0.16 | 0.12 | 0.43 | 0.11 | NA | NA | Yes | No |
| S609T | −0.76 | 0.12 | 0.55 | 0.09 | NA | NA | Yes | No |
| S609W | −1.36 | 0.13 | −0.51 | 0.10 | NA | NA | Yes | No |
| T610A | −0.40 | 0.05 | −0.40 | 0.05 | −0.93 | 0.09 | No | No |
| T610R | −1.61 | 0.07 | −0.98 | 0.06 | −1.76 | 0.15 | No | No |
| T610N | −0.27 | 0.10 | −0.20 | 0.10 | −0.58 | 0.12 | No | No |
| T610C | −0.26 | 0.09 | −0.31 | 0.09 | NA | NA | Yes | No |
| T610Q | NA | NA | NA | NA | −0.53 | 0.36 | Yes | No |
| T610G | −1.36 | 0.05 | −1.25 | 0.05 | −1.62 | 0.12 | No | No |
| T610I | −0.82 | 0.11 | −0.98 | 0.12 | NA | NA | Yes | No |
| T610L | −1.78 | 0.11 | −2.29 | 0.14 | NA | NA | Yes | No |
| T610P | 0.07 | 0.04 | 0.33 | 0.04 | −0.62 | 0.08 | Yes | No |
| T610S | −0.35 | 0.06 | −0.62 | 0.06 | −0.53 | 0.07 | No | No |
| T610V | 0.26 | 0.05 | −1.14 | 0.08 | −1.58 | 0.17 | Yes | No |
| Q611A | −2.61 | 0.13 | −1.23 | 0.08 | −1.40 | 0.13 | No | No |
| Q611R | −0.68 | 0.04 | −0.69 | 0.04 | −1.33 | 0.04 | No | No |
| Q611E | −1.22 | 0.07 | −0.58 | 0.06 | −1.18 | 0.11 | No | No |
| Q611G | −1.38 | 0.05 | −1.84 | 0.06 | −1.82 | 0.08 | No | No |
| Q611H | 0.04 | 0.07 | −0.20 | 0.07 | −0.91 | 0.13 | Yes | No |
| Q611L | −1.21 | 0.08 | −1.74 | 0.10 | −1.67 | 0.16 | No | No |
| Q611K | −0.93 | 0.09 | −0.83 | 0.09 | −1.38 | 0.16 | No | No |
| Q611P | 0.13 | 0.06 | −0.14 | 0.06 | −0.81 | 0.08 | Yes | No |
| Q611S | −2.07 | 0.11 | −0.89 | 0.07 | NA | NA | Yes | No |
| Q611* | −0.75 | 0.09 | −1.11 | 0.10 | −1.17 | 0.16 | No | No |
| Q611W | −1.28 | 0.08 | −0.88 | 0.07 | NA | NA | Yes | No |
| Q611V | −1.42 | 0.07 | −1.15 | 0.07 | NA | NA | Yes | No |
| L612M | 0.70 | 0.07 | 0.70 | 0.07 | 0.01 | 0.03 | Yes | Yes |
| L612A | −1.32 | 0.11 | −1.11 | 0.11 | −0.98 | 0.22 | No | No |
| L612R | 0.03 | 0.05 | 0.16 | 0.05 | −0.58 | 0.11 | Yes | No |
| L612Q | −0.94 | 0.10 | −0.43 | 0.09 | NA | NA | Yes | No |
| L612E | −1.18 | 0.11 | −1.65 | 0.13 | NA | NA | Yes | No |
| L612G | −0.97 | 0.07 | −2.15 | 0.11 | −1.70 | 0.17 | No | No |
| L612I | −0.18 | 0.13 | 0.66 | 0.11 | −0.24 | 0.15 | Yes | No |
| L612K | −1.41 | 0.16 | −0.48 | 0.12 | NA | NA | Yes | No |
| L612P | −0.34 | 0.06 | −0.33 | 0.06 | −0.72 | 0.11 | No | No |
| L612* | −1.69 | 0.15 | −0.55 | 0.10 | NA | NA | Yes | No |
| L612T | −0.27 | 0.09 | −1.35 | 0.13 | NA | NA | Yes | No |
| L612V | −1.05 | 0.08 | −0.90 | 0.08 | −1.51 | 0.05 | No | No |
| K613R | −0.22 | 0.06 | −0.18 | 0.06 | −0.40 | 0.05 | No | No |
| K613N | 0.04 | 0.10 | 0.16 | 0.10 | NA | NA | Yes | No |
| K613Q | 0.14 | 0.04 | 0.38 | 0.04 | NA | NA | Yes | No |
| K613E | −0.75 | 0.08 | 0.06 | 0.07 | NA | NA | Yes | No |
| K613G | −1.17 | 0.08 | −1.36 | 0.09 | NA | NA | Yes | No |
| K613L | 0.12 | 0.09 | 0.49 | 0.09 | −0.52 | 0.26 | Yes | No |
| K613M | −0.26 | 0.11 | 0.73 | 0.09 | NA | NA | Yes | No |
| K613* | −0.72 | 0.11 | −0.72 | 0.11 | NA | NA | Yes | No |
| K613T | 0.26 | 0.05 | 0.46 | 0.05 | −0.65 | 0.08 | Yes | No |
| K613W | −1.27 | 0.12 | −1.60 | 0.14 | NA | NA | Yes | No |
| K613V | −0.89 | 0.10 | −0.25 | 0.08 | NA | NA | Yes | No |
| A614R | 0.28 | 0.04 | 0.07 | 0.05 | 0.16 | 0.05 | Yes | Yes |
| A614I | 0.52 | 0.11 | 0.59 | 0.11 | 0.41 | 0.22 | Yes | Yes |
| A614D | −0.02 | 0.08 | −0.34 | 0.09 | NA | NA | Yes | No |
| A614C | −0.54 | 0.09 | −0.12 | 0.08 | 0.02 | 0.22 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| A614Q | 0.50 | 0.10 | 0.17 | 0.11 | NA | NA | Yes | No |
| A614E | −0.71 | 0.08 | −0.80 | 0.09 | NA | NA | Yes | No |
| A614G | −0.16 | 0.03 | 0.09 | 0.03 | −0.21 | 0.08 | Yes | No |
| A614L | 0.09 | 0.06 | −0.21 | 0.06 | 0.02 | 0.12 | Yes | No |
| A614K | NA | NA | NA | NA | 0.28 | 0.38 | Yes | No |
| A614M | −0.39 | 0.13 | 1.39 | 0.09 | NA | NA | Yes | No |
| A614F | −0.66 | 0.14 | −0.11 | 0.12 | NA | NA | Yes | No |
| A614P | −0.22 | 0.09 | −0.09 | 0.09 | −0.68 | 0.25 | No | No |
| A614S | −0.46 | 0.07 | 0.19 | 0.06 | −0.55 | 0.15 | Yes | No |
| A614* | NA | NA | NA | NA | −0.35 | 0.32 | Yes | No |
| A614T | 0.03 | 0.06 | 0.37 | 0.06 | −0.49 | 0.14 | Yes | No |
| A614W | −0.74 | 0.07 | −0.88 | 0.08 | −0.97 | 0.14 | No | No |
| A614V | 0.17 | 0.04 | 0.29 | 0.04 | −0.03 | 0.11 | Yes | No |
| V615A | −0.05 | 0.03 | 0.09 | 0.03 | −0.35 | 0.04 | Yes | No |
| V615R | −1.73 | 0.05 | −1.23 | 0.04 | −1.21 | 0.07 | No | No |
| V615N | −0.21 | 0.08 | −1.01 | 0.11 | −0.72 | 0.15 | No | No |
| V615D | −0.95 | 0.07 | −0.97 | 0.07 | −1.54 | 0.13 | No | No |
| V615C | −0.18 | 0.06 | −0.18 | 0.06 | −0.01 | 0.19 | No | No |
| V615Q | −1.87 | 0.10 | −1.41 | 0.09 | NA | NA | Yes | No |
| V615E | −0.82 | 0.04 | −0.59 | 0.04 | −1.03 | 0.05 | No | No |
| V615G | −0.57 | 0.03 | −0.88 | 0.03 | −1.19 | 0.04 | No | No |
| V615I | −0.51 | 0.09 | −0.73 | 0.10 | −0.67 | 0.23 | No | No |
| V615L | −0.07 | 0.03 | 0.05 | 0.03 | −0.88 | 0.05 | Yes | No |
| V615K | −1.22 | 0.08 | −1.81 | 0.10 | −1.56 | 0.07 | No | No |
| V615M | −0.52 | 0.06 | −0.54 | 0.06 | −0.54 | 0.12 | No | No |
| V615F | −1.88 | 0.14 | −1.30 | 0.12 | NA | NA | Yes | No |
| V615P | −1.53 | 0.10 | −1.82 | 0.11 | −1.42 | 0.06 | No | No |
| V615S | 0.17 | 0.04 | −0.23 | 0.04 | −0.63 | 0.05 | Yes | No |
| V615* | −1.04 | 0.07 | −0.78 | 0.07 | −1.35 | 0.16 | No | No |
| V615T | 0.19 | 0.05 | −0.12 | 0.06 | −0.07 | 0.17 | Yes | No |
| V615W | −1.19 | 0.06 | −1.55 | 0.07 | −1.90 | 0.05 | No | No |
| T616A | 0.32 | 0.03 | 0.24 | 0.04 | 0.09 | 0.05 | Yes | Yes |
| T616R | 0.19 | 0.03 | 0.12 | 0.03 | 0.62 | 0.04 | Yes | Yes |
| T616Q | 0.35 | 0.07 | 0.38 | 0.07 | 0.78 | 0.20 | Yes | Yes |
| T616G | 0.22 | 0.03 | 0.01 | 0.03 | 0.16 | 0.06 | Yes | Yes |
| T616Y | 0.54 | 0.09 | 0.64 | 0.09 | 0.05 | 0.38 | Yes | Yes |
| T616N | −0.11 | 0.08 | 0.20 | 0.08 | 0.16 | 0.07 | Yes | No |
| T616D | −0.66 | 0.08 | 0.14 | 0.07 | −0.18 | 0.26 | Yes | No |
| T616C | 0.54 | 0.06 | 0.27 | 0.06 | −0.24 | 0.11 | Yes | No |
| T616E | −0.28 | 0.06 | −0.38 | 0.06 | −0.17 | 0.07 | No | No |
| T616H | 0.62 | 0.08 | −0.13 | 0.10 | 1.21 | 0.25 | Yes | No |
| T616I | −0.33 | 0.08 | 0.30 | 0.07 | 0.19 | 0.18 | Yes | No |
| T616L | −0.27 | 0.05 | −0.43 | 0.05 | −0.19 | 0.13 | No | No |
| T616K | −0.36 | 0.08 | 0.23 | 0.07 | 0.66 | 0.09 | Yes | No |
| T616M | −0.49 | 0.08 | −0.40 | 0.08 | −0.44 | 0.25 | No | No |
| T616F | −0.58 | 0.11 | 0.07 | 0.09 | 0.10 | 0.36 | Yes | No |
| T616P | −0.89 | 0.07 | −0.68 | 0.07 | −0.80 | 0.06 | No | No |
| T616S | −0.02 | 0.04 | 0.12 | 0.04 | 0.13 | 0.07 | Yes | No |
| T616* | NA | NA | NA | NA | −1.14 | 0.24 | Yes | No |
| T616W | −0.28 | 0.05 | 0.25 | 0.04 | −0.22 | 0.19 | Yes | No |
| T616V | −0.07 | 0.04 | −0.09 | 0.04 | 0.21 | 0.07 | Yes | No |
| A617G | 0.03 | 0.03 | 0.05 | 0.03 | 0.24 | 0.06 | Yes | Yes |
| A617R | −0.10 | 0.04 | 0.07 | 0.04 | −0.32 | 0.11 | Yes | No |
| A617N | NA | NA | NA | NA | 0.12 | 0.42 | Yes | No |
| A617D | −0.76 | 0.09 | −0.05 | 0.07 | NA | NA | Yes | No |
| A617C | −0.73 | 0.09 | 0.26 | 0.07 | 0.13 | 0.18 | Yes | No |
| A617Q | 0.25 | 0.08 | 0.07 | 0.09 | −0.48 | 0.30 | Yes | No |
| A617E | −0.12 | 0.06 | 0.08 | 0.06 | −0.40 | 0.20 | Yes | No |
| A617H | −0.11 | 0.11 | −0.46 | 0.12 | NA | NA | Yes | No |
| A617I | −0.26 | 0.11 | 0.09 | 0.10 | −0.52 | 0.38 | Yes | No |
| A617L | −0.11 | 0.05 | 0.18 | 0.05 | −0.18 | 0.16 | Yes | No |
| A617K | NA | NA | NA | NA | −0.08 | 0.28 | Yes | No |
| A617M | 0.32 | 0.07 | 0.30 | 0.07 | −0.34 | 0.27 | Yes | No |
| A617F | −0.17 | 0.10 | −0.39 | 0.11 | −0.42 | 0.36 | No | No |
| A617P | −0.48 | 0.08 | −0.88 | 0.09 | 0.05 | 0.18 | Yes | No |
| A617S | −0.13 | 0.05 | 0.25 | 0.05 | −0.58 | 0.06 | Yes | No |
| A617* | −0.96 | 0.11 | −1.57 | 0.14 | NA | NA | Yes | No |
| A617T | −0.23 | 0.05 | 0.26 | 0.05 | −0.30 | 0.10 | Yes | No |
| A617W | 0.17 | 0.05 | −0.93 | 0.07 | −0.69 | 0.15 | Yes | No |
| A617V | −0.03 | 0.04 | −0.09 | 0.04 | −0.42 | 0.12 | No | No |
| H618A | −0.73 | 0.14 | −0.80 | 0.15 | 0.36 | 0.36 | Yes | No |
| H618R | −0.08 | 0.05 | 0.24 | 0.05 | −0.46 | 0.06 | Yes | No |
| H618N | −0.37 | 0.17 | −0.24 | 0.16 | NA | NA | Yes | No |
| H618D | 0.48 | 0.13 | 0.89 | 0.12 | NA | NA | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| H618Q | −0.62 | 0.14 | 0.01 | 0.12 | NA | NA | Yes | No |
| H618G | −0.56 | 0.07 | −0.91 | 0.09 | −0.91 | 0.19 | No | No |
| H618L | 0.02 | 0.06 | 0.10 | 0.06 | −0.47 | 0.07 | Yes | No |
| H618P | 0.32 | 0.08 | 0.47 | 0.08 | −0.51 | 0.08 | Yes | No |
| H618S | −0.50 | 0.14 | −0.26 | 0.13 | NA | NA | Yes | No |
| H618W | NA | NA | NA | NA | 0.44 | 0.31 | Yes | No |
| H618Y | 0.23 | 0.10 | −0.28 | 0.11 | −0.26 | 0.19 | Yes | No |
| F619M | 0.12 | 0.07 | 0.55 | 0.07 | 0.22 | 0.25 | Yes | Yes |
| F619A | −0.57 | 0.05 | −1.25 | 0.06 | −0.78 | 0.05 | No | No |
| F619R | −1.24 | 0.05 | −1.94 | 0.07 | −0.66 | 0.07 | No | No |
| F619N | −0.61 | 0.13 | −0.15 | 0.12 | NA | NA | Yes | No |
| F619D | −1.39 | 0.12 | −0.62 | 0.09 | NA | NA | Yes | No |
| F619C | 0.07 | 0.03 | 0.08 | 0.03 | −0.37 | 0.04 | Yes | No |
| F619Q | −1.13 | 0.12 | −1.57 | 0.15 | NA | NA | Yes | No |
| F619E | −1.58 | 0.08 | −2.40 | 0.12 | −1.54 | 0.08 | No | No |
| F619G | −1.29 | 0.03 | −1.03 | 0.03 | −1.57 | 0.05 | No | No |
| F619H | NA | NA | NA | NA | −0.31 | 0.34 | Yes | No |
| F619I | −0.69 | 0.12 | −0.28 | 0.11 | −0.42 | 0.22 | No | No |
| F619L | 0.17 | 0.03 | 0.12 | 0.03 | −0.48 | 0.05 | Yes | No |
| F619P | −1.00 | 0.09 | −1.22 | 0.10 | NA | NA | Yes | No |
| F619S | −0.26 | 0.04 | −0.95 | 0.06 | −0.56 | 0.06 | No | No |
| F619* | −1.91 | 0.14 | −0.92 | 0.10 | NA | NA | Yes | No |
| F619T | NA | NA | NA | NA | −1.08 | 0.24 | Yes | No |
| F619W | −0.08 | 0.04 | −0.81 | 0.05 | 0.00 | 0.07 | Yes | No |
| F619Y | 0.06 | 0.08 | −0.79 | 0.11 | 0.28 | 0.11 | Yes | No |
| F619V | −0.51 | 0.04 | −0.49 | 0.04 | −0.64 | 0.04 | No | No |
| Q620A | 0.22 | 0.04 | 0.00 | 0.05 | 0.18 | 0.09 | Yes | Yes |
| Q620R | 0.25 | 0.03 | 0.18 | 0.03 | 0.17 | 0.04 | Yes | Yes |
| Q620N | 0.26 | 0.14 | 0.28 | 0.14 | 0.36 | 0.21 | Yes | Yes |
| Q620L | 0.14 | 0.04 | 0.45 | 0.04 | 0.40 | 0.16 | Yes | Yes |
| Q620K | 0.10 | 0.07 | 0.24 | 0.07 | 0.04 | 0.10 | Yes | Yes |
| Q620D | −0.16 | 0.07 | −0.25 | 0.08 | 0.24 | 0.23 | Yes | No |
| Q620C | −0.22 | 0.07 | −0.95 | 0.10 | 0.03 | 0.23 | Yes | No |
| Q620E | 0.21 | 0.05 | 0.13 | 0.05 | −0.09 | 0.10 | Yes | No |
| Q620G | −0.14 | 0.02 | 0.02 | 0.02 | 0.19 | 0.04 | Yes | No |
| Q620H | −0.08 | 0.08 | 0.16 | 0.08 | −0.05 | 0.20 | Yes | No |
| Q620I | 0.27 | 0.11 | −0.38 | 0.14 | NA | NA | Yes | No |
| Q620M | 0.70 | 0.07 | −0.03 | 0.08 | 0.20 | 0.26 | Yes | No |
| Q620F | 0.37 | 0.11 | 1.00 | 0.10 | −0.47 | 0.44 | Yes | No |
| Q620P | −0.04 | 0.06 | 0.12 | 0.06 | −0.26 | 0.10 | Yes | No |
| Q620S | 0.17 | 0.05 | −0.15 | 0.06 | 0.16 | 0.17 | Yes | No |
| Q620* | −0.82 | 0.08 | −0.58 | 0.07 | −0.64 | 0.15 | No | No |
| Q620T | −0.20 | 0.09 | 0.41 | 0.08 | 0.17 | 0.12 | Yes | No |
| Q620W | −0.12 | 0.04 | 0.09 | 0.04 | 0.08 | 0.11 | Yes | No |
| Q620Y | −0.74 | 0.14 | 0.21 | 0.11 | −0.19 | 0.38 | Yes | No |
| Q620V | 0.29 | 0.03 | −0.11 | 0.04 | 0.26 | 0.07 | Yes | No |
| T621A | 0.18 | 0.04 | 0.13 | 0.04 | 0.17 | 0.10 | Yes | Yes |
| T621R | −0.04 | 0.04 | −0.45 | 0.05 | −0.06 | 0.15 | No | No |
| T621N | −0.39 | 0.12 | −0.09 | 0.11 | 0.02 | 0.21 | Yes | No |
| T621D | 0.12 | 0.12 | 0.26 | 0.12 | −0.11 | 0.44 | Yes | No |
| T621C | 0.07 | 0.09 | −0.29 | 0.10 | NA | NA | Yes | No |
| T621Q | −0.90 | 0.12 | 0.06 | 0.10 | 0.44 | 0.38 | Yes | No |
| T621E | −0.29 | 0.07 | 0.13 | 0.06 | −0.05 | 0.24 | Yes | No |
| T621G | −0.02 | 0.03 | −0.21 | 0.04 | 0.48 | 0.04 | Yes | No |
| T621H | 0.33 | 0.15 | 0.72 | 0.14 | NA | NA | Yes | No |
| T621I | 0.36 | 0.08 | −0.09 | 0.10 | 0.21 | 0.20 | Yes | No |
| T621L | 0.16 | 0.06 | −0.40 | 0.07 | −0.30 | 0.10 | Yes | No |
| T621K | −0.02 | 0.09 | −0.09 | 0.09 | −0.08 | 0.37 | No | No |
| T621M | 0.21 | 0.07 | −0.15 | 0.08 | 1.17 | 0.09 | Yes | No |
| T621F | −0.61 | 0.16 | −0.16 | 0.14 | NA | NA | Yes | No |
| T621P | 0.04 | 0.04 | 0.18 | 0.04 | −0.38 | 0.06 | Yes | No |
| T621S | −0.06 | 0.06 | −0.08 | 0.06 | 0.28 | 0.09 | Yes | No |
| T621W | −0.21 | 0.06 | 0.08 | 0.06 | 0.12 | 0.17 | Yes | No |
| T621Y | −0.23 | 0.16 | 0.36 | 0.14 | NA | NA | Yes | No |
| T621V | −0.28 | 0.05 | 0.32 | 0.05 | 0.32 | 0.19 | Yes | No |
| H622G | 0.05 | 0.03 | 0.18 | 0.03 | 0.07 | 0.06 | Yes | Yes |
| H622S | 0.16 | 0.06 | 0.59 | 0.06 | 0.08 | 0.10 | Yes | Yes |
| H622T | 0.01 | 0.09 | 0.84 | 0.08 | 0.31 | 0.34 | Yes | Yes |
| H622V | 0.18 | 0.05 | 0.15 | 0.05 | 0.31 | 0.12 | Yes | Yes |
| H622A | −0.17 | 0.06 | 0.16 | 0.06 | 0.41 | 0.08 | Yes | No |
| H622R | −0.19 | 0.04 | 0.12 | 0.04 | 0.05 | 0.04 | Yes | No |
| H622N | −0.05 | 0.07 | 0.30 | 0.07 | −0.11 | 0.12 | Yes | No |
| H622D | −0.84 | 0.11 | 0.63 | 0.07 | 0.48 | 0.10 | Yes | No |
| H622C | −0.50 | 0.09 | −0.10 | 0.08 | 0.11 | 0.11 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| H622Q | −0.06 | 0.08 | 0.29 | 0.07 | −0.14 | 0.05 | Yes | No |
| H622E | −0.11 | 0.07 | 0.15 | 0.06 | 0.23 | 0.10 | Yes | No |
| H622I | −0.05 | 0.14 | 0.45 | 0.13 | 0.36 | 0.49 | Yes | No |
| H622L | −0.49 | 0.06 | 0.06 | 0.05 | −0.14 | 0.11 | Yes | No |
| H622K | 0.29 | 0.10 | 1.39 | 0.08 | 0.00 | 0.28 | Yes | No |
| H622M | −0.07 | 0.11 | −0.07 | 0.11 | 0.05 | 0.34 | Yes | No |
| H622F | 0.14 | 0.11 | −0.61 | 0.14 | 0.07 | 0.13 | Yes | No |
| H622P | 0.14 | 0.03 | 0.25 | 0.03 | −0.44 | 0.04 | Yes | No |
| H622* | −1.50 | 0.13 | −1.18 | 0.12 | −0.74 | 0.16 | No | No |
| H622W | 0.08 | 0.05 | 0.21 | 0.05 | −0.08 | 0.19 | Yes | No |
| H622Y | 0.07 | 0.09 | 0.14 | 0.09 | −0.08 | 0.18 | Yes | No |
| T623E | 0.32 | 0.05 | 0.23 | 0.05 | 0.02 | 0.05 | Yes | Yes |
| T623H | 0.60 | 0.10 | 0.01 | 0.11 | 0.58 | 0.55 | Yes | Yes |
| T623L | 0.33 | 0.05 | 0.18 | 0.05 | 0.17 | 0.16 | Yes | Yes |
| T623M | 0.21 | 0.07 | 0.28 | 0.07 | 0.59 | 0.22 | Yes | Yes |
| T623F | 0.80 | 0.10 | 0.61 | 0.10 | 0.47 | 0.32 | Yes | Yes |
| T623A | −0.14 | 0.04 | 0.35 | 0.03 | −0.04 | 0.07 | Yes | No |
| T623R | −0.16 | 0.03 | −0.40 | 0.04 | 0.15 | 0.09 | Yes | No |
| T623N | 0.02 | 0.09 | 0.19 | 0.09 | −0.28 | 0.16 | Yes | No |
| T623D | −0.69 | 0.09 | 0.41 | 0.07 | −0.34 | 0.14 | Yes | No |
| T623C | −0.39 | 0.08 | 0.01 | 0.08 | 0.40 | 0.28 | Yes | No |
| T623Q | 0.23 | 0.07 | 0.38 | 0.07 | −0.01 | 0.32 | Yes | No |
| T623G | −0.40 | 0.03 | −0.09 | 0.03 | −0.05 | 0.03 | No | No |
| T623I | −0.59 | 0.10 | 0.11 | 0.08 | −0.13 | 0.13 | Yes | No |
| T623K | 1.10 | 0.07 | −0.02 | 0.08 | 0.53 | 0.17 | Yes | No |
| T623P | −0.16 | 0.06 | −0.29 | 0.07 | −0.11 | 0.17 | No | No |
| T623S | 0.67 | 0.04 | 0.21 | 0.04 | −0.06 | 0.07 | Yes | No |
| T623W | −0.01 | 0.05 | −0.29 | 0.06 | −0.27 | 0.10 | No | No |
| T623Y | NA | NA | NA | NA | −0.11 | 0.29 | Yes | No |
| T623V | −0.26 | 0.04 | −0.20 | 0.04 | 0.41 | 0.05 | Yes | No |
| T624P | 0.92 | 0.02 | 0.92 | 0.02 | 0.04 | 0.03 | Yes | Yes |
| T624A | 0.65 | 0.02 | 0.76 | 0.02 | −0.07 | 0.03 | Yes | No |
| T624R | 0.41 | 0.07 | 0.34 | 0.07 | −0.55 | 0.23 | Yes | No |
| T624N | 0.15 | 0.10 | 0.20 | 0.10 | NA | NA | Yes | No |
| T624C | −0.20 | 0.15 | 0.21 | 0.14 | NA | NA | Yes | No |
| T624E | 0.38 | 0.09 | −0.63 | 0.12 | −0.11 | 0.55 | Yes | No |
| T624G | −0.21 | 0.06 | 0.12 | 0.06 | 0.15 | 0.21 | Yes | No |
| T624I | 0.58 | 0.11 | 0.35 | 0.11 | NA | NA | Yes | No |
| T624L | 0.41 | 0.09 | −0.84 | 0.13 | 0.96 | 0.48 | Yes | No |
| T624S | 1.15 | 0.04 | 1.20 | 0.04 | −0.13 | 0.04 | Yes | No |
| T624W | 0.56 | 0.10 | −0.20 | 0.12 | 0.10 | 0.16 | Yes | No |
| T624V | −0.12 | 0.08 | −0.52 | 0.10 | 0.18 | 0.23 | Yes | No |
| P625A | −0.27 | 0.11 | 0.30 | 0.10 | 0.31 | 0.10 | Yes | No |
| P625R | 0.06 | 0.07 | −1.01 | 0.10 | −0.04 | 0.22 | Yes | No |
| P625C | 0.56 | 0.14 | −0.17 | 0.16 | −0.02 | 0.82 | Yes | No |
| P625E | −0.24 | 0.13 | −0.22 | 0.13 | −0.41 | 0.64 | No | No |
| P625G | −0.41 | 0.08 | 0.40 | 0.06 | 0.04 | 0.24 | Yes | No |
| P625H | −0.25 | 0.15 | −0.02 | 0.15 | NA | NA | Yes | No |
| P625L | −0.48 | 0.09 | −0.82 | 0.11 | −0.56 | 0.17 | No | No |
| P625S | −0.38 | 0.08 | −0.55 | 0.09 | 0.03 | 0.20 | Yes | No |
| P625T | 0.30 | 0.08 | 0.23 | 0.08 | −0.06 | 0.10 | Yes | No |
| P625W | −0.60 | 0.13 | −0.64 | 0.13 | NA | NA | Yes | No |
| P625V | −0.17 | 0.09 | −0.63 | 0.11 | NA | NA | Yes | No |
| I626A | 0.16 | 0.12 | 0.80 | 0.11 | NA | NA | Yes | No |
| I626R | −0.89 | 0.12 | 0.14 | 0.09 | −0.09 | 0.31 | Yes | No |
| I626N | 0.42 | 0.04 | 0.61 | 0.04 | −0.37 | 0.06 | Yes | No |
| I626E | NA | NA | NA | NA | −0.15 | 0.55 | Yes | No |
| I626G | −1.04 | 0.10 | −1.35 | 0.12 | −0.48 | 0.27 | No | No |
| I626L | 0.61 | 0.11 | −0.85 | 0.16 | NA | NA | Yes | No |
| I626S | 0.36 | 0.04 | 0.60 | 0.04 | −0.65 | 0.07 | Yes | No |
| I626T | 0.17 | 0.02 | 0.34 | 0.02 | −0.37 | 0.03 | Yes | No |
| I626W | −0.74 | 0.16 | 0.22 | 0.13 | NA | NA | Yes | No |
| I626V | −0.51 | 0.10 | 0.05 | 0.09 | 0.10 | 0.18 | Yes | No |
| L627C | 0.14 | 0.13 | 0.84 | 0.11 | 0.57 | 0.48 | Yes | Yes |
| L627A | 0.00 | 0.08 | 0.24 | 0.08 | 1.31 | 0.29 | Yes | No |
| L627R | 0.29 | 0.04 | 0.03 | 0.04 | −0.10 | 0.05 | Yes | No |
| L627N | 0.71 | 0.15 | 1.09 | 0.15 | NA | NA | Yes | No |
| L627D | 0.32 | 0.10 | −1.12 | 0.16 | 1.13 | 0.55 | Yes | No |
| L627Q | 0.23 | 0.07 | 0.39 | 0.07 | −0.27 | 0.11 | Yes | No |
| L627E | 0.29 | 0.07 | −0.06 | 0.08 | 0.17 | 0.11 | Yes | No |
| L627G | −0.04 | 0.04 | −0.01 | 0.04 | 0.23 | 0.10 | Yes | No |
| L627K | 0.57 | 0.11 | 0.27 | 0.12 | NA | NA | Yes | No |
| L627M | −0.57 | 0.12 | 0.33 | 0.10 | −0.09 | 0.22 | Yes | No |
| L627P | 0.10 | 0.05 | 0.31 | 0.05 | −0.25 | 0.08 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| L627S | 0.34 | 0.08 | 0.18 | 0.08 | −0.29 | 0.27 | Yes | No |
| L627* | 0.52 | 0.10 | −0.87 | 0.15 | NA | NA | Yes | No |
| L627T | 0.60 | 0.09 | −0.76 | 0.14 | NA | NA | Yes | No |
| L627W | −0.71 | 0.09 | 0.85 | 0.07 | 0.27 | 0.32 | Yes | No |
| L627V | −0.89 | 0.08 | 0.48 | 0.06 | −0.23 | 0.19 | Yes | No |
| L628C | 0.31 | 0.09 | 0.10 | 0.10 | 0.29 | 0.31 | Yes | Yes |
| L628W | 0.25 | 0.06 | 0.01 | 0.07 | 0.67 | 0.15 | Yes | Yes |
| L628A | −0.22 | 0.06 | −0.58 | 0.07 | −0.36 | 0.11 | No | No |
| L628R | −0.13 | 0.04 | −0.50 | 0.05 | 0.53 | 0.06 | Yes | No |
| L628Q | −0.10 | 0.10 | −0.04 | 0.10 | −0.36 | 0.23 | No | No |
| L628E | −0.73 | 0.10 | −1.59 | 0.14 | NA | NA | Yes | No |
| L628G | −0.65 | 0.04 | −1.57 | 0.06 | −0.96 | 0.14 | No | No |
| L628I | −0.47 | 0.17 | −0.57 | 0.17 | NA | NA | Yes | No |
| L628K | 0.75 | 0.11 | −0.44 | 0.15 | −0.21 | 0.31 | Yes | No |
| L628M | −0.49 | 0.09 | −0.37 | 0.09 | −0.21 | 0.12 | No | No |
| L628P | −0.27 | 0.08 | −0.45 | 0.08 | −0.39 | 0.14 | No | No |
| L628S | −0.78 | 0.08 | −1.36 | 0.10 | −0.83 | 0.21 | No | No |
| L628T | −0.16 | 0.10 | −0.52 | 0.12 | −0.60 | 0.27 | No | No |
| L628V | −0.13 | 0.05 | 0.34 | 0.05 | −0.31 | 0.09 | Yes | No |
| S629A | −0.99 | 0.12 | 0.49 | 0.08 | −0.09 | 0.29 | Yes | No |
| S629R | 0.10 | 0.02 | 0.29 | 0.02 | −0.37 | 0.03 | Yes | No |
| S629N | 0.40 | 0.05 | 0.36 | 0.05 | −0.32 | 0.08 | Yes | No |
| S629D | −0.54 | 0.18 | −0.23 | 0.17 | NA | NA | Yes | No |
| S629C | 0.30 | 0.10 | 0.10 | 0.11 | −0.08 | 0.21 | Yes | No |
| S629Q | 0.76 | 0.17 | 0.40 | 0.18 | NA | NA | Yes | No |
| S629E | 0.84 | 0.10 | 0.61 | 0.11 | −0.08 | 0.48 | Yes | No |
| S629G | −0.30 | 0.05 | 0.40 | 0.05 | 0.09 | 0.08 | Yes | No |
| S629I | 0.05 | 0.14 | 0.42 | 0.13 | NA | NA | Yes | No |
| S629L | NA | NA | NA | NA | 0.03 | 0.36 | Yes | No |
| S629K | 0.37 | 0.13 | 0.80 | 0.12 | NA | NA | Yes | No |
| S629P | −0.03 | 0.15 | −0.34 | 0.17 | NA | NA | Yes | No |
| S629T | −0.60 | 0.13 | 0.01 | 0.11 | 0.22 | 0.32 | Yes | No |
| S629W | −0.03 | 0.11 | −0.66 | 0.13 | 0.42 | 0.54 | Yes | No |
| S629V | −0.87 | 0.11 | −0.82 | 0.11 | 0.05 | 0.14 | Yes | No |
| N630R | 0.53 | 0.05 | 0.06 | 0.06 | 0.94 | 0.08 | Yes | Yes |
| N630A | −0.53 | 0.09 | 0.62 | 0.07 | −0.06 | 0.23 | Yes | No |
| N630D | −0.33 | 0.09 | 0.49 | 0.07 | −0.22 | 0.14 | Yes | No |
| N630C | 0.42 | 0.10 | −0.12 | 0.12 | NA | NA | Yes | No |
| N630E | −0.67 | 0.09 | 0.69 | 0.07 | −0.30 | 0.26 | Yes | No |
| N630G | 0.32 | 0.04 | −0.11 | 0.04 | 0.22 | 0.10 | Yes | No |
| N630H | 0.06 | 0.10 | 0.51 | 0.09 | −0.29 | 0.13 | Yes | No |
| N630I | −0.45 | 0.12 | 0.44 | 0.10 | −0.27 | 0.18 | Yes | No |
| N630L | −0.24 | 0.09 | 0.55 | 0.08 | −0.78 | 0.15 | Yes | No |
| N630K | 0.37 | 0.10 | 0.93 | 0.09 | −0.25 | 0.18 | Yes | No |
| N630F | −0.58 | 0.18 | −0.11 | 0.16 | NA | NA | Yes | No |
| N630S | 0.34 | 0.06 | −0.21 | 0.07 | 0.16 | 0.13 | Yes | No |
| N630T | 0.16 | 0.03 | 0.38 | 0.02 | −0.53 | 0.04 | Yes | No |
| N630W | −0.11 | 0.09 | −1.04 | 0.12 | NA | NA | Yes | No |
| N630Y | −0.24 | 0.12 | 0.59 | 0.10 | 0.14 | 0.19 | Yes | No |
| N630V | −0.20 | 0.06 | −0.90 | 0.08 | −0.26 | 0.18 | No | No |
| N631A | −0.03 | 0.07 | 0.06 | 0.07 | −0.70 | 0.25 | Yes | No |
| N631R | −0.11 | 0.06 | 0.27 | 0.05 | 1.20 | 0.07 | Yes | No |
| N631D | −0.56 | 0.10 | −0.38 | 0.09 | −0.77 | 0.13 | No | No |
| N631C | −0.71 | 0.15 | −0.64 | 0.15 | NA | NA | Yes | No |
| N631E | NA | NA | NA | NA | −0.95 | 0.23 | Yes | No |
| N631G | −0.67 | 0.05 | −0.39 | 0.05 | −1.02 | 0.07 | No | No |
| N631I | 0.31 | 0.10 | −0.62 | 0.13 | NA | NA | Yes | No |
| N631L | −1.12 | 0.10 | −0.57 | 0.08 | NA | NA | Yes | No |
| N631K | −0.05 | 0.08 | −0.20 | 0.09 | 0.70 | 0.11 | Yes | No |
| N631M | −0.10 | 0.10 | 0.36 | 0.09 | −0.27 | 0.30 | Yes | No |
| N631P | 0.06 | 0.12 | 0.30 | 0.12 | NA | NA | Yes | No |
| N631S | 0.15 | 0.06 | 0.06 | 0.06 | −0.36 | 0.13 | Yes | No |
| N631T | 0.07 | 0.04 | 0.24 | 0.04 | −0.37 | 0.05 | Yes | No |
| N631Y | −0.48 | 0.12 | −0.03 | 0.11 | NA | NA | Yes | No |
| N631V | −0.66 | 0.07 | −1.17 | 0.08 | −0.78 | 0.23 | No | No |
| F632A | −0.79 | 0.07 | −1.34 | 0.09 | −1.29 | 0.12 | No | No |
| F632R | −0.76 | 0.05 | −0.40 | 0.05 | −0.13 | 0.05 | No | No |
| F632D | −1.62 | 0.15 | −1.61 | 0.15 | NA | NA | Yes | No |
| F632C | 0.66 | 0.02 | 0.78 | 0.02 | −0.06 | 0.02 | Yes | No |
| F632Q | NA | NA | NA | NA | −0.18 | 0.55 | Yes | No |
| F632E | −1.35 | 0.10 | −0.87 | 0.09 | NA | NA | Yes | No |
| F632G | −0.01 | 0.03 | 0.12 | 0.03 | −0.03 | 0.02 | Yes | No |
| F632H | −0.31 | 0.16 | 0.08 | 0.15 | NA | NA | Yes | No |
| F632I | −0.33 | 0.10 | −0.01 | 0.10 | −0.87 | 0.13 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| F632L | −0.28 | 0.05 | 0.22 | 0.05 | −0.26 | 0.07 | Yes | No |
| F632K | −0.49 | 0.13 | 0.74 | 0.10 | NA | NA | Yes | No |
| F632M | 0.00 | 0.10 | 0.16 | 0.10 | NA | NA | Yes | No |
| F632S | −0.75 | 0.06 | −0.56 | 0.06 | −0.83 | 0.06 | No | No |
| F632* | −0.69 | 0.12 | −0.55 | 0.12 | NA | NA | Yes | No |
| F632T | −0.09 | 0.09 | −0.80 | 0.12 | NA | NA | Yes | No |
| F632W | 0.17 | 0.06 | −0.14 | 0.06 | −0.44 | 0.19 | Yes | No |
| F632Y | −0.15 | 0.08 | 0.38 | 0.07 | −0.07 | 0.10 | Yes | No |
| F632V | 0.38 | 0.02 | 0.41 | 0.02 | −0.07 | 0.02 | Yes | No |
| I633N | 0.16 | 0.06 | 0.65 | 0.06 | 0.15 | 0.10 | Yes | Yes |
| I633M | 0.17 | 0.07 | 0.28 | 0.07 | 0.10 | 0.19 | Yes | Yes |
| I633S | 0.02 | 0.04 | 0.35 | 0.04 | 0.22 | 0.08 | Yes | Yes |
| I633A | 0.15 | 0.05 | −0.24 | 0.06 | 0.42 | 0.13 | Yes | No |
| I633R | −0.42 | 0.04 | 0.41 | 0.04 | 0.22 | 0.06 | Yes | No |
| I633D | −0.62 | 0.09 | −0.01 | 0.08 | −0.12 | 0.10 | No | No |
| I633C | 0.15 | 0.07 | −0.34 | 0.08 | −0.04 | 0.14 | Yes | No |
| I633Q | −0.26 | 0.10 | 1.05 | 0.08 | −0.37 | 0.22 | Yes | No |
| I633E | −0.98 | 0.07 | −0.34 | 0.06 | 0.30 | 0.11 | Yes | No |
| I633G | −0.09 | 0.03 | 0.10 | 0.03 | 0.05 | 0.06 | Yes | No |
| I633H | −0.71 | 0.14 | −0.16 | 0.13 | NA | NA | Yes | No |
| I633L | −0.10 | 0.05 | 0.00 | 0.05 | 0.25 | 0.06 | Yes | No |
| I633K | −0.29 | 0.09 | 0.17 | 0.08 | 0.63 | 0.29 | Yes | No |
| I633F | −0.11 | 0.09 | 0.24 | 0.09 | 0.51 | 0.22 | Yes | No |
| I633P | 0.23 | 0.08 | −0.90 | 0.12 | 0.19 | 0.31 | Yes | No |
| I633* | −1.45 | 0.12 | −1.53 | 0.13 | NA | NA | Yes | No |
| I633T | 0.13 | 0.04 | 0.40 | 0.04 | −0.17 | 0.06 | Yes | No |
| I633W | −0.35 | 0.05 | 0.14 | 0.05 | −0.07 | 0.09 | Yes | No |
| I633Y | NA | NA | NA | NA | −0.09 | 0.34 | Yes | No |
| I633V | 0.09 | 0.04 | −0.06 | 0.04 | 0.39 | 0.06 | Yes | No |
| E634N | 0.52 | 0.12 | 0.46 | 0.12 | 0.00 | 0.36 | Yes | Yes |
| E634A | 0.20 | 0.02 | 0.38 | 0.02 | −0.36 | 0.03 | Yes | No |
| E634R | −0.06 | 0.04 | 0.30 | 0.04 | 0.33 | 0.08 | Yes | No |
| E634D | −0.10 | 0.06 | 0.30 | 0.06 | 0.01 | 0.10 | Yes | No |
| E634C | −0.12 | 0.08 | −0.30 | 0.09 | 0.42 | 0.13 | Yes | No |
| E634Q | −0.28 | 0.09 | 0.79 | 0.07 | 0.35 | 0.10 | Yes | No |
| E634G | −0.12 | 0.03 | 0.10 | 0.02 | 0.33 | 0.03 | Yes | No |
| E634I | 0.43 | 0.13 | −0.05 | 0.15 | NA | NA | Yes | No |
| E634L | 0.12 | 0.05 | −0.46 | 0.06 | 0.47 | 0.19 | Yes | No |
| E634K | 0.14 | 0.06 | −0.04 | 0.07 | 0.16 | 0.13 | Yes | No |
| E634M | −0.14 | 0.08 | −0.22 | 0.08 | 0.42 | 0.27 | Yes | No |
| E634F | 0.25 | 0.14 | 0.08 | 0.15 | NA | NA | Yes | No |
| E634P | −0.23 | 0.10 | −0.95 | 0.13 | NA | NA | Yes | No |
| E634S | −0.22 | 0.06 | 0.07 | 0.05 | 0.30 | 0.07 | Yes | No |
| E634* | 0.11 | 0.03 | 0.29 | 0.03 | −0.34 | 0.05 | Yes | No |
| E634T | 0.01 | 0.09 | 0.30 | 0.08 | −0.51 | 0.28 | Yes | No |
| E634W | −0.46 | 0.06 | 0.16 | 0.05 | 0.45 | 0.17 | Yes | No |
| E634V | −0.20 | 0.04 | 0.26 | 0.04 | 0.33 | 0.08 | Yes | No |
| P635A | 0.04 | 0.05 | 0.29 | 0.05 | 0.59 | 0.07 | Yes | Yes |
| P635D | 0.14 | 0.09 | 0.49 | 0.09 | 0.52 | 0.14 | Yes | Yes |
| P635E | 0.51 | 0.06 | 0.49 | 0.06 | 0.70 | 0.16 | Yes | Yes |
| P635T | 0.36 | 0.06 | 0.06 | 0.06 | 0.01 | 0.08 | Yes | Yes |
| P635R | −0.51 | 0.04 | −0.39 | 0.04 | 0.24 | 0.08 | Yes | No |
| P635N | 0.13 | 0.14 | −0.31 | 0.16 | NA | NA | Yes | No |
| P635C | −0.65 | 0.10 | −0.70 | 0.11 | 0.26 | 0.25 | Yes | No |
| P635Q | −0.86 | 0.12 | −0.40 | 0.11 | 0.43 | 0.38 | Yes | No |
| P635G | −0.01 | 0.03 | −0.02 | 0.03 | 0.15 | 0.06 | Yes | No |
| P635H | −0.05 | 0.10 | 0.20 | 0.09 | 0.22 | 0.07 | Yes | No |
| P635I | NA | NA | NA | NA | 0.13 | 0.37 | Yes | No |
| P635L | −0.02 | 0.05 | −0.33 | 0.06 | 0.22 | 0.10 | Yes | No |
| P635K | NA | NA | NA | NA | 0.18 | 0.41 | Yes | No |
| P635M | 0.96 | 0.08 | −0.61 | 0.12 | 0.06 | 0.31 | Yes | No |
| P635F | 1.00 | 0.11 | 0.14 | 0.13 | NA | NA | Yes | No |
| P635S | −0.22 | 0.06 | 0.35 | 0.05 | 0.02 | 0.12 | Yes | No |
| P635W | −0.24 | 0.06 | 0.25 | 0.06 | −0.12 | 0.20 | Yes | No |
| P635Y | −0.31 | 0.15 | −0.01 | 0.14 | NA | NA | Yes | No |
| P635V | −0.06 | 0.05 | −0.29 | 0.05 | 0.44 | 0.20 | Yes | No |
| L636A | −0.52 | 0.05 | −1.17 | 0.06 | 0.08 | 0.11 | Yes | No |
| L636R | −1.28 | 0.04 | −1.29 | 0.04 | −1.27 | 0.08 | No | No |
| L636C | −0.14 | 0.07 | −0.19 | 0.07 | −0.07 | 0.17 | No | No |
| L636Q | −0.25 | 0.05 | −0.09 | 0.05 | −0.16 | 0.09 | No | No |
| L636E | −1.02 | 0.07 | −0.96 | 0.07 | −1.27 | 0.21 | No | No |
| L636G | −1.44 | 0.04 | −1.31 | 0.04 | −1.36 | 0.06 | No | No |
| L636I | −0.87 | 0.13 | −0.24 | 0.11 | NA | NA | Yes | No |
| L636K | −0.17 | 0.08 | −0.33 | 0.09 | −1.00 | 0.28 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| L636M | −0.40 | 0.07 | −0.08 | 0.06 | 0.16 | 0.16 | Yes | No |
| L636F | −0.45 | 0.10 | 0.29 | 0.09 | NA | NA | Yes | No |
| L636P | 0.24 | 0.05 | −0.84 | 0.06 | −0.88 | 0.11 | Yes | No |
| L636S | −1.62 | 0.07 | −1.47 | 0.07 | −0.73 | 0.15 | No | No |
| L636* | −1.09 | 0.10 | −1.51 | 0.12 | NA | NA | Yes | No |
| L636T | 0.12 | 0.06 | −2.04 | 0.13 | −0.41 | 0.09 | Yes | No |
| L636W | −0.55 | 0.05 | −1.36 | 0.06 | −0.68 | 0.11 | No | No |
| L636V | −0.35 | 0.04 | −0.05 | 0.03 | −0.65 | 0.08 | No | No |
| E637A | 0.15 | 0.04 | 0.23 | 0.04 | −0.25 | 0.07 | Yes | No |
| E637R | −0.23 | 0.07 | 1.02 | 0.06 | 0.18 | 0.32 | Yes | No |
| E637D | −0.88 | 0.14 | −0.01 | 0.11 | NA | NA | Yes | No |
| E637Q | 0.83 | 0.14 | 0.47 | 0.15 | NA | NA | Yes | No |
| E637G | −0.05 | 0.04 | 0.22 | 0.04 | 0.06 | 0.05 | Yes | No |
| E637L | NA | NA | NA | NA | 0.35 | 0.32 | Yes | No |
| E637K | −0.33 | 0.12 | −0.66 | 0.13 | NA | NA | Yes | No |
| E637M | 0.60 | 0.15 | 1.04 | 0.14 | NA | NA | Yes | No |
| E637S | 0.23 | 0.10 | −0.55 | 0.12 | 0.66 | 0.39 | Yes | No |
| E637* | −0.03 | 0.09 | 0.24 | 0.08 | NA | NA | Yes | No |
| E637W | −0.18 | 0.10 | −0.73 | 0.12 | −0.20 | 0.34 | No | No |
| E637V | −0.15 | 0.07 | −0.36 | 0.07 | −0.45 | 0.10 | No | No |
| I638R | −1.56 | 0.13 | −0.55 | 0.10 | NA | NA | Yes | No |
| I638N | 0.35 | 0.16 | 0.42 | 0.16 | −0.63 | 0.15 | Yes | No |
| I638C | 1.11 | 0.14 | −0.05 | 0.17 | NA | NA | Yes | No |
| I638L | NA | NA | NA | NA | −0.24 | 0.30 | Yes | No |
| I638S | 0.04 | 0.05 | 0.05 | 0.05 | −0.18 | 0.05 | Yes | No |
| I638T | −0.43 | 0.12 | −0.42 | 0.12 | −0.14 | 0.18 | No | No |
| I638V | 0.39 | 0.07 | −0.45 | 0.08 | −0.04 | 0.13 | Yes | No |
| T639G | 0.52 | 0.06 | 0.44 | 0.06 | 0.06 | 0.23 | Yes | Yes |
| T639A | 0.25 | 0.05 | 0.47 | 0.05 | −0.34 | 0.06 | Yes | No |
| T639R | −0.48 | 0.10 | −0.68 | 0.11 | −0.16 | 0.35 | No | No |
| T639N | 0.03 | 0.16 | −0.02 | 0.17 | NA | NA | Yes | No |
| T639D | 0.61 | 0.17 | 0.43 | 0.18 | NA | NA | Yes | No |
| T639E | 0.71 | 0.12 | 0.82 | 0.12 | NA | NA | Yes | No |
| T639I | 0.17 | 0.13 | −0.19 | 0.14 | NA | NA | Yes | No |
| T639L | −0.28 | 0.15 | −0.39 | 0.16 | NA | NA | Yes | No |
| T639P | −0.10 | 0.12 | 0.08 | 0.12 | −0.21 | 0.22 | Yes | No |
| T639S | 0.07 | 0.07 | 0.09 | 0.07 | −0.53 | 0.12 | Yes | No |
| T639V | 0.75 | 0.09 | −1.09 | 0.14 | 0.78 | 0.28 | Yes | No |
| K640A | −0.31 | 0.07 | −0.59 | 0.07 | 0.20 | 0.26 | Yes | No |
| K640R | −0.15 | 0.04 | 0.07 | 0.04 | 0.01 | 0.11 | Yes | No |
| K640N | 0.07 | 0.03 | 0.32 | 0.03 | −0.43 | 0.05 | Yes | No |
| K640D | −0.14 | 0.09 | −0.73 | 0.11 | −0.52 | 0.30 | No | No |
| K640C | 0.06 | 0.08 | 0.34 | 0.08 | −0.51 | 0.27 | Yes | No |
| K640Q | −0.86 | 0.12 | 0.36 | 0.09 | 0.29 | 0.31 | Yes | No |
| K640E | −0.30 | 0.06 | 0.08 | 0.06 | −0.03 | 0.15 | Yes | No |
| K640G | −0.26 | 0.04 | −0.59 | 0.04 | −0.48 | 0.12 | No | No |
| K640H | 0.81 | 0.12 | −0.26 | 0.15 | NA | NA | Yes | No |
| K640I | −0.10 | 0.12 | −0.11 | 0.12 | NA | NA | Yes | No |
| K640L | 0.21 | 0.06 | 0.05 | 0.06 | −0.31 | 0.20 | Yes | No |
| K640M | −1.04 | 0.15 | 0.36 | 0.10 | −0.12 | 0.31 | Yes | No |
| K640F | 0.24 | 0.12 | −0.13 | 0.13 | NA | NA | Yes | No |
| K640P | 0.40 | 0.09 | 0.14 | 0.10 | −0.03 | 0.55 | Yes | No |
| K640S | −0.60 | 0.07 | 0.52 | 0.06 | −0.11 | 0.22 | Yes | No |
| K640* | −0.85 | 0.10 | −0.19 | 0.09 | −0.96 | 0.21 | No | No |
| K640T | 0.10 | 0.03 | 0.35 | 0.03 | −0.52 | 0.06 | Yes | No |
| K640W | −0.53 | 0.07 | 0.41 | 0.06 | 0.12 | 0.25 | Yes | No |
| K640Y | −0.76 | 0.15 | −0.28 | 0.14 | 0.36 | 0.37 | Yes | No |
| K640V | −0.26 | 0.05 | −0.56 | 0.05 | 0.05 | 0.11 | Yes | No |
| D840S | 0.37 | 0.08 | 0.33 | 0.08 | 0.10 | 0.16 | Yes | Yes |
| D840A | −0.07 | 0.07 | 0.40 | 0.06 | 0.18 | 0.13 | Yes | No |
| D840R | −0.03 | 0.05 | 0.09 | 0.05 | 0.10 | 0.33 | Yes | No |
| D840N | −0.64 | 0.12 | −0.31 | 0.11 | −0.04 | 0.16 | No | No |
| D840C | 0.62 | 0.12 | −1.20 | 0.16 | 0.07 | 0.48 | Yes | No |
| D840Q | −0.22 | 0.14 | −0.03 | 0.13 | 0.34 | NA | Yes | No |
| D840E | 0.32 | 0.07 | −0.07 | 0.07 | 0.08 | 0.06 | Yes | No |
| D840G | 0.21 | 0.04 | −0.26 | 0.04 | 0.02 | 0.05 | Yes | No |
| D840L | −0.64 | 0.10 | −0.25 | 0.09 | −0.27 | 0.82 | No | No |
| D840K | 0.13 | 0.13 | 0.33 | 0.12 | −0.03 | 0.82 | Yes | No |
| D840M | NA | NA | NA | NA | −0.30 | 0.13 | Yes | No |
| D840P | −0.09 | 0.12 | −0.12 | 0.12 | 0.11 | 0.82 | Yes | No |
| D840T | −1.14 | 0.14 | 0.11 | 0.10 | 0.29 | 0.15 | Yes | No |
| D840W | −0.33 | 0.09 | 0.05 | 0.08 | −0.39 | 0.19 | Yes | No |
| D840Y | 0.13 | 0.08 | 0.11 | 0.08 | −0.18 | 0.11 | Yes | No |
| D840V | 0.16 | 0.06 | −0.03 | 0.06 | −0.10 | 0.07 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| E841A | −0.26 | 0.06 | −0.54 | 0.06 | 0.08 | 0.08 | Yes | No |
| E841R | −0.66 | 0.06 | −0.57 | 0.05 | −0.18 | 0.10 | No | No |
| E841N | 0.04 | 0.14 | −0.53 | 0.15 | −0.14 | 0.48 | Yes | No |
| E841D | −0.33 | 0.09 | −0.04 | 0.08 | 0.12 | 0.15 | Yes | No |
| E841C | −0.43 | 0.13 | −0.39 | 0.12 | −0.46 | 0.16 | No | No |
| E841Q | −0.64 | 0.12 | −0.41 | 0.11 | 0.21 | 0.14 | Yes | No |
| E841G | 0.21 | 0.04 | −0.11 | 0.04 | −0.04 | 0.04 | Yes | No |
| E841H | −0.71 | 0.18 | −0.82 | 0.18 | NA | NA | Yes | No |
| E841L | −1.39 | 0.10 | −0.35 | 0.07 | −0.41 | 0.06 | No | No |
| E841K | −0.55 | 0.09 | −0.26 | 0.09 | −0.34 | 0.17 | No | No |
| E841M | −1.21 | 0.14 | −0.41 | 0.11 | −0.24 | 0.54 | No | No |
| E841P | −0.22 | 0.11 | −0.23 | 0.11 | 0.00 | 0.08 | No | No |
| E841S | −0.16 | 0.07 | −0.22 | 0.07 | 0.04 | 0.10 | Yes | No |
| E841* | −0.19 | 0.06 | −0.19 | 0.06 | 0.07 | 0.03 | Yes | No |
| E841T | 0.40 | 0.09 | −0.59 | 0.10 | −0.27 | 0.19 | Yes | No |
| E841W | −1.06 | 0.09 | −1.15 | 0.09 | −1.11 | 0.33 | No | No |
| E841V | −0.99 | 0.07 | −0.68 | 0.06 | −0.53 | 0.08 | No | No |
| A842S | 0.36 | 0.06 | 0.08 | 0.06 | 0.04 | 0.10 | Yes | Yes |
| A842R | −2.56 | 0.11 | −1.06 | 0.06 | −1.25 | 0.15 | No | No |
| A842D | −0.37 | 0.11 | −1.49 | 0.15 | −1.07 | 0.19 | No | No |
| A842C | 0.15 | 0.10 | −0.39 | 0.11 | −0.26 | 0.13 | Yes | No |
| A842E | NA | NA | NA | NA | −1.19 | 0.12 | Yes | No |
| A842G | −0.18 | 0.04 | −0.18 | 0.04 | −0.09 | 0.04 | No | No |
| A842L | −1.71 | 0.11 | −1.29 | 0.09 | −1.19 | 0.33 | No | No |
| A842K | −0.53 | 0.13 | −1.41 | 0.16 | NA | NA | Yes | No |
| A842P | −0.87 | 0.10 | −0.94 | 0.10 | NA | NA | Yes | No |
| A842T | −1.47 | 0.11 | −0.57 | 0.08 | −1.03 | 0.10 | No | No |
| A842W | −1.87 | 0.12 | −1.92 | 0.12 | −1.46 | 0.40 | No | No |
| A842V | −1.40 | 0.08 | −0.77 | 0.06 | −1.17 | 0.20 | No | No |
| R843A | −0.28 | 0.10 | 0.30 | 0.09 | 0.15 | 0.11 | Yes | No |
| R843E | −1.03 | 0.17 | −1.31 | 0.17 | 0.09 | 0.64 | Yes | No |
| R843G | 0.18 | 0.05 | −0.37 | 0.06 | −0.43 | 0.07 | Yes | No |
| R843L | −0.31 | 0.13 | −0.08 | 0.12 | −0.05 | 0.30 | No | No |
| R843K | −0.16 | 0.13 | 0.01 | 0.12 | 0.45 | 0.16 | Yes | No |
| R843M | NA | NA | NA | NA | 0.26 | 0.83 | Yes | No |
| R843S | −0.08 | 0.07 | 0.08 | 0.07 | −0.08 | 0.10 | Yes | No |
| R843* | −0.64 | 0.17 | −0.23 | 0.15 | NA | NA | Yes | No |
| R843T | NA | NA | NA | NA | −0.19 | 0.30 | Yes | No |
| R843W | −0.99 | 0.15 | 0.22 | 0.12 | −0.55 | 0.14 | Yes | No |
| R843V | −0.09 | 0.10 | −0.23 | 0.10 | 0.04 | 0.17 | Yes | No |
| A844E | 0.38 | 0.10 | 0.06 | 0.10 | 0.13 | 0.21 | Yes | Yes |
| A844R | 0.45 | 0.07 | −0.04 | 0.07 | 0.03 | 0.37 | Yes | No |
| A844D | NA | NA | NA | NA | 0.36 | 0.11 | Yes | No |
| A844C | NA | NA | NA | NA | 0.02 | 0.19 | Yes | No |
| A844Q | −0.26 | 0.18 | 0.84 | 0.15 | −0.11 | 0.44 | Yes | No |
| A844G | −0.48 | 0.06 | −0.26 | 0.05 | −0.01 | 0.06 | No | No |
| A844L | 0.54 | 0.10 | −0.25 | 0.11 | 0.18 | 0.14 | Yes | No |
| A844K | NA | NA | NA | NA | 0.14 | 0.27 | Yes | No |
| A844M | NA | NA | NA | NA | 0.23 | 0.41 | Yes | No |
| A844P | 0.28 | 0.11 | −1.04 | 0.14 | −0.72 | 0.25 | Yes | No |
| A844S | −0.22 | 0.08 | −0.06 | 0.07 | 0.17 | 0.10 | Yes | No |
| A844T | −0.37 | 0.11 | −0.05 | 0.10 | 0.22 | 0.21 | Yes | No |
| A844W | −1.01 | 0.13 | −0.64 | 0.11 | −0.10 | NA | No | No |
| A844V | −0.19 | 0.08 | 0.12 | 0.07 | 0.06 | 0.08 | Yes | No |
| L845A | −0.70 | 0.08 | −0.23 | 0.07 | −0.59 | 0.11 | No | No |
| L845R | −2.01 | 0.10 | −1.83 | 0.09 | −1.29 | 0.05 | No | No |
| L845C | −0.27 | 0.14 | −0.84 | 0.15 | −0.37 | 0.82 | No | No |
| L845Q | NA | NA | NA | NA | −0.49 | 0.25 | Yes | No |
| L845E | −0.93 | 0.12 | −1.26 | 0.13 | −0.79 | 0.48 | No | No |
| L845G | −1.31 | 0.06 | −1.09 | 0.06 | −1.46 | 0.20 | No | No |
| L845K | −0.17 | 0.18 | 0.03 | 0.17 | NA | NA | Yes | No |
| L845M | −0.15 | 0.12 | −0.17 | 0.12 | −0.20 | 0.25 | No | No |
| L845P | −0.64 | 0.10 | −0.71 | 0.10 | −0.61 | 0.11 | No | No |
| L845S | −1.48 | 0.13 | −0.91 | 0.10 | −0.82 | 0.35 | No | No |
| L845T | −0.85 | 0.14 | 0.43 | 0.11 | NA | NA | Yes | No |
| L845W | −0.12 | 0.08 | −1.89 | 0.13 | −0.47 | 0.33 | No | No |
| L845V | −0.31 | 0.06 | −0.80 | 0.07 | −0.20 | 0.10 | No | No |
| L846A | −1.10 | 0.08 | −0.78 | 0.07 | −0.78 | 0.82 | No | No |
| L846R | −0.86 | 0.06 | −0.85 | 0.05 | −1.09 | 0.11 | No | No |
| L846C | −1.57 | 0.15 | −1.32 | 0.13 | −0.93 | 0.14 | No | No |
| L846Q | −1.21 | 0.15 | −0.87 | 0.13 | −0.99 | 0.27 | No | No |
| L846E | −0.34 | 0.08 | −0.41 | 0.08 | −0.71 | 0.17 | No | No |
| L846G | −1.11 | 0.05 | −0.81 | 0.05 | −1.29 | 0.15 | No | No |
| L846I | NA | NA | NA | NA | 0.11 | 0.49 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| L846M | −0.29 | 0.09 | 0.19 | 0.08 | −0.28 | 0.13 | Yes | No |
| L846F | −0.48 | 0.14 | −0.27 | 0.13 | NA | NA | Yes | No |
| L846P | −1.04 | 0.10 | −0.74 | 0.09 | −0.74 | 0.13 | No | No |
| L846S | −0.77 | 0.09 | −0.24 | 0.08 | −1.23 | 0.37 | No | No |
| L846T | −0.74 | 0.12 | −1.37 | 0.14 | −0.56 | 0.12 | No | No |
| L846W | −1.13 | 0.09 | −0.51 | 0.08 | −0.35 | 0.06 | No | No |
| L846Y | −0.02 | 0.16 | −0.98 | 0.19 | NA | NA | Yes | No |
| L846V | −1.23 | 0.07 | −0.61 | 0.06 | −0.40 | 0.06 | No | No |
| P847A | 0.24 | 0.11 | −1.48 | 0.16 | NA | NA | Yes | No |
| P847R | −0.47 | 0.09 | −0.88 | 0.10 | −1.09 | 0.26 | No | No |
| P847G | −0.32 | 0.07 | −1.12 | 0.08 | −0.48 | 0.43 | No | No |
| P847H | −0.24 | 0.18 | −0.19 | 0.17 | −0.10 | 0.18 | No | No |
| P847L | −1.09 | 0.12 | −0.92 | 0.11 | −0.76 | 0.15 | No | No |
| P847S | −0.42 | 0.11 | −0.55 | 0.11 | −0.76 | 0.23 | No | No |
| P847T | −0.69 | 0.19 | −0.89 | 0.19 | NA | NA | Yes | No |
| P847V | −0.31 | 0.12 | −1.08 | 0.14 | NA | NA | Yes | No |
| N848A | −0.53 | 0.11 | 0.02 | 0.10 | 0.14 | 0.43 | Yes | No |
| N848R | −0.30 | 0.07 | −0.60 | 0.07 | −0.35 | 0.10 | No | No |
| N848D | 0.06 | 0.11 | −0.08 | 0.11 | −0.13 | 0.15 | Yes | No |
| N848C | −0.16 | 0.14 | −0.15 | 0.14 | −0.31 | NA | No | No |
| N848Q | −0.31 | 0.18 | −0.55 | 0.19 | NA | NA | Yes | No |
| N848E | −0.64 | 0.11 | 0.35 | 0.09 | 0.48 | 0.09 | Yes | No |
| N848G | −0.87 | 0.07 | −0.40 | 0.06 | −0.33 | 0.11 | No | No |
| N848H | −0.07 | 0.05 | 0.05 | 0.05 | −0.06 | 0.05 | Yes | No |
| N848I | 0.00 | 0.17 | −0.09 | 0.17 | NA | NA | Yes | No |
| N848L | 0.08 | 0.10 | −1.50 | 0.14 | −0.10 | NA | Yes | No |
| N848K | −0.25 | 0.14 | −0.45 | 0.14 | −0.20 | 0.19 | No | No |
| N848M | NA | NA | NA | NA | 0.10 | 0.64 | Yes | No |
| N848S | −0.89 | 0.10 | −0.37 | 0.08 | −0.30 | 0.16 | No | No |
| N848T | 0.37 | 0.12 | −0.11 | 0.12 | −0.17 | 0.11 | Yes | No |
| N848W | −0.76 | 0.12 | −0.04 | 0.10 | 0.22 | 0.40 | Yes | No |
| N848Y | −0.61 | 0.18 | 0.16 | 0.16 | −0.20 | 0.24 | Yes | No |
| N848V | −0.51 | 0.09 | −0.84 | 0.10 | −0.29 | 0.64 | No | No |
| V849A | −0.93 | 0.12 | 0.41 | 0.09 | −0.39 | 0.18 | Yes | No |
| V849R | −1.79 | 0.16 | −1.96 | 0.16 | −1.01 | 0.29 | No | No |
| V849G | −1.07 | 0.08 | −1.40 | 0.08 | −1.48 | 0.05 | No | No |
| V849L | 0.90 | 0.09 | −0.43 | 0.11 | −0.12 | 0.13 | Yes | No |
| V849M | −0.12 | 0.12 | −0.31 | 0.12 | −0.19 | 0.19 | No | No |
| I850A | 0.25 | 0.05 | −0.76 | 0.06 | −0.17 | 0.06 | Yes | No |
| I850R | −0.32 | 0.04 | −0.27 | 0.04 | −0.21 | 0.06 | No | No |
| I850N | −0.38 | 0.13 | −0.44 | 0.13 | −0.50 | 0.10 | No | No |
| I850D | −1.19 | 0.12 | −0.73 | 0.10 | −0.71 | 0.54 | No | No |
| I850C | −0.30 | 0.08 | 0.19 | 0.08 | 0.13 | 0.14 | Yes | No |
| I850Q | −0.08 | 0.11 | −0.31 | 0.11 | 0.00 | 0.43 | No | No |
| I850E | −0.24 | 0.07 | −0.45 | 0.07 | −0.35 | 0.25 | No | No |
| I850G | −0.90 | 0.04 | −0.86 | 0.04 | −0.96 | 0.06 | No | No |
| I850H | 0.45 | 0.12 | −0.44 | 0.13 | −0.29 | 0.54 | Yes | No |
| I850L | −0.15 | 0.04 | −0.17 | 0.04 | −0.26 | 0.05 | No | No |
| I850K | −1.20 | 0.13 | −0.19 | 0.10 | −0.01 | 0.82 | No | No |
| I850M | −0.83 | 0.09 | −0.82 | 0.09 | −0.28 | 0.18 | No | No |
| I850F | −0.83 | 0.11 | −0.97 | 0.11 | −0.61 | 0.17 | No | No |
| I850P | −0.43 | 0.09 | −1.72 | 0.12 | −1.01 | 0.12 | No | No |
| I850S | −0.42 | 0.06 | −0.18 | 0.05 | −0.52 | 0.06 | No | No |
| I850T | 0.00 | 0.07 | −0.22 | 0.07 | 0.06 | 0.07 | Yes | No |
| I850W | −1.02 | 0.07 | −1.26 | 0.08 | −0.97 | 0.10 | No | No |
| I850V | −0.03 | 0.04 | 0.12 | 0.04 | 0.22 | 0.05 | Yes | No |
| T851A | 0.41 | 0.06 | 0.14 | 0.06 | 0.08 | 0.10 | Yes | Yes |
| T851V | 0.32 | 0.06 | 0.13 | 0.06 | 0.54 | 0.07 | Yes | Yes |
| T851R | −0.18 | 0.06 | −0.82 | 0.06 | −0.93 | 0.17 | No | No |
| T851C | 0.00 | 0.14 | −0.03 | 0.14 | −0.11 | 0.82 | No | No |
| T851Q | NA | NA | NA | NA | −0.17 | 0.29 | Yes | No |
| T851E | −0.44 | 0.09 | −0.88 | 0.10 | −0.08 | 0.08 | No | No |
| T851G | −1.22 | 0.06 | −0.82 | 0.05 | −0.95 | 0.19 | No | No |
| T851I | 0.21 | 0.13 | −0.17 | 0.13 | 0.20 | 0.20 | Yes | No |
| T851L | 0.35 | 0.08 | 0.01 | 0.09 | −0.05 | 0.37 | Yes | No |
| T851K | −0.23 | 0.14 | −0.49 | 0.14 | NA | NA | Yes | No |
| T851M | 0.52 | 0.11 | −0.71 | 0.14 | −0.02 | 0.23 | Yes | No |
| T851F | −0.32 | 0.18 | 0.44 | 0.16 | 0.28 | NA | Yes | No |
| T851P | −0.06 | 0.04 | 0.04 | 0.04 | 0.03 | 0.05 | Yes | No |
| T851S | −0.01 | 0.07 | −0.04 | 0.07 | −0.08 | 0.13 | No | No |
| T851W | 0.07 | 0.09 | −0.34 | 0.09 | −0.01 | 0.48 | Yes | No |
| K852A | −1.49 | 0.14 | −1.41 | 0.13 | NA | NA | Yes | No |
| K852R | −0.07 | 0.06 | −0.48 | 0.07 | −0.37 | 0.10 | No | No |
| K852N | 0.12 | 0.10 | −0.39 | 0.11 | 0.01 | 0.08 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| K852Q | −0.04 | 0.05 | 0.10 | 0.04 | 0.14 | 0.06 | Yes | No |
| K852E | −0.99 | 0.12 | −0.80 | 0.11 | −1.03 | 0.07 | No | No |
| K852G | −1.42 | 0.09 | −2.60 | 0.13 | −1.20 | 0.18 | No | No |
| K852P | −0.25 | 0.07 | −0.24 | 0.07 | −0.22 | 0.08 | No | No |
| K852S | −1.14 | 0.13 | −0.56 | 0.10 | −0.56 | 0.48 | No | No |
| K852* | −0.98 | 0.15 | −1.24 | 0.16 | NA | NA | Yes | No |
| K852T | −0.16 | 0.03 | −0.02 | 0.03 | 0.16 | 0.04 | Yes | No |
| K852V | −0.65 | 0.09 | −0.18 | 0.08 | −0.78 | 0.48 | No | No |
| E853V | 0.14 | 0.07 | 0.10 | 0.07 | 0.38 | 0.09 | Yes | Yes |
| E853A | −0.49 | 0.08 | −0.35 | 0.08 | −0.05 | 0.09 | No | No |
| E853R | 0.23 | 0.06 | −0.13 | 0.06 | −0.20 | 0.31 | Yes | No |
| E853D | −0.30 | 0.10 | −0.26 | 0.10 | 0.42 | 0.18 | Yes | No |
| E853C | 0.07 | 0.11 | 0.12 | 0.11 | −0.24 | 0.13 | Yes | No |
| E853Q | −0.55 | 0.17 | 0.09 | 0.14 | 0.17 | 0.31 | Yes | No |
| E853G | −0.18 | 0.04 | −0.41 | 0.05 | −0.47 | 0.07 | No | No |
| E853L | −0.85 | 0.10 | 0.03 | 0.08 | 0.08 | 0.08 | Yes | No |
| E853K | 0.05 | 0.12 | −0.95 | 0.15 | 0.21 | 0.20 | Yes | No |
| E853M | −0.08 | 0.15 | −0.94 | 0.17 | 0.01 | 0.11 | Yes | No |
| E853P | 0.46 | 0.13 | −0.02 | 0.14 | 0.28 | 0.40 | Yes | No |
| E853S | −0.30 | 0.09 | −0.41 | 0.09 | 0.07 | 0.15 | Yes | No |
| E853* | −0.52 | 0.09 | −0.38 | 0.09 | −0.25 | 0.08 | No | No |
| E853T | −0.33 | 0.15 | −0.61 | 0.15 | 0.57 | 0.25 | Yes | No |
| E853W | 0.25 | 0.08 | −1.68 | 0.12 | −0.52 | 0.14 | Yes | No |
| V854A | −0.95 | 0.08 | −0.31 | 0.06 | −0.94 | 0.15 | No | No |
| V854R | −1.42 | 0.07 | −1.14 | 0.06 | −1.31 | 0.13 | No | No |
| V854D | −0.58 | 0.13 | −1.22 | 0.15 | NA | NA | Yes | No |
| V854C | −0.91 | 0.13 | −0.17 | 0.11 | −0.54 | 0.35 | No | No |
| V854E | −1.32 | 0.11 | −1.01 | 0.09 | −1.15 | 0.18 | No | No |
| V854G | −1.40 | 0.06 | −1.44 | 0.06 | −1.28 | 0.09 | No | No |
| V854L | −1.49 | 0.10 | −0.60 | 0.07 | −1.28 | 0.13 | No | No |
| V854M | −1.32 | 0.13 | −1.02 | 0.11 | −0.94 | 0.16 | No | No |
| V854P | −1.29 | 0.16 | −1.22 | 0.15 | NA | NA | Yes | No |
| V854S | −1.58 | 0.12 | −0.89 | 0.09 | −1.26 | 0.21 | No | No |
| V854W | −1.48 | 0.10 | −0.37 | 0.07 | −1.34 | 0.06 | No | No |
| S855A | 0.70 | 0.10 | −0.77 | 0.12 | 0.01 | 0.40 | Yes | No |
| S855R | 0.40 | 0.10 | −0.66 | 0.11 | 0.61 | 0.12 | Yes | No |
| S855C | −0.24 | 0.17 | 0.37 | 0.15 | NA | NA | Yes | No |
| S855G | 0.01 | 0.07 | −0.69 | 0.08 | −0.49 | 0.48 | Yes | No |
| S855L | NA | NA | NA | NA | −0.20 | 0.82 | Yes | No |
| S855F | −0.02 | 0.17 | 0.31 | 0.16 | NA | NA | Yes | No |
| S855P | −0.31 | 0.12 | 0.14 | 0.10 | −0.08 | 0.16 | Yes | No |
| S855T | 0.53 | 0.13 | −0.42 | 0.15 | 0.41 | 0.24 | Yes | No |
| S855Y | NA | NA | NA | NA | 0.21 | 0.29 | Yes | No |
| S855V | 0.17 | 0.13 | 0.00 | 0.14 | 0.24 | 0.82 | Yes | No |
| H856R | −0.04 | 0.07 | −0.29 | 0.07 | −0.62 | 0.16 | No | No |
| H856N | −1.01 | 0.17 | −0.62 | 0.15 | NA | NA | Yes | No |
| H856E | −0.49 | 0.12 | −0.23 | 0.11 | NA | NA | Yes | No |
| H856G | −0.96 | 0.07 | −1.35 | 0.07 | −1.43 | 0.08 | No | No |
| H856L | −0.83 | 0.12 | −0.29 | 0.10 | −0.42 | 0.20 | No | No |
| H856P | −0.26 | 0.09 | 0.07 | 0.09 | −0.29 | 0.09 | Yes | No |
| H856S | −1.39 | 0.17 | −0.13 | 0.12 | NA | NA | Yes | No |
| H856W | NA | NA | NA | NA | −0.62 | 0.17 | Yes | No |
| H856Y | −0.65 | 0.16 | −0.05 | 0.13 | 0.50 | 0.20 | Yes | No |
| H856V | NA | NA | NA | NA | −0.60 | 0.21 | Yes | No |
| E857A | −0.23 | 0.05 | −0.30 | 0.05 | −0.51 | 0.06 | No | No |
| E857R | −0.92 | 0.06 | −1.30 | 0.06 | −1.05 | 0.13 | No | No |
| E857D | 0.50 | 0.09 | −0.31 | 0.10 | −1.09 | 0.21 | Yes | No |
| E857C | −0.44 | 0.13 | −1.14 | 0.15 | −0.59 | 0.40 | No | No |
| E857Q | −0.89 | 0.14 | −1.04 | 0.14 | −0.73 | 0.29 | No | No |
| E857G | −0.98 | 0.04 | −0.90 | 0.04 | −1.19 | 0.03 | No | No |
| E857L | −0.09 | 0.08 | −0.75 | 0.09 | −0.99 | 0.22 | No | No |
| E857K | 0.23 | 0.09 | −0.93 | 0.11 | −0.76 | 0.14 | Yes | No |
| E857M | −0.36 | 0.13 | −0.31 | 0.12 | NA | NA | Yes | No |
| E857P | −0.10 | 0.11 | −0.53 | 0.12 | −0.58 | 0.54 | No | No |
| E857S | −0.17 | 0.08 | −0.67 | 0.08 | −0.71 | 0.16 | No | No |
| E857* | −1.28 | 0.15 | −0.53 | 0.12 | NA | NA | Yes | No |
| E857T | −1.10 | 0.14 | 0.08 | 0.10 | −0.09 | 0.54 | Yes | No |
| E857W | −0.75 | 0.08 | −1.02 | 0.08 | −1.03 | 0.15 | No | No |
| E857V | −0.10 | 0.05 | −0.43 | 0.05 | −0.29 | 0.08 | No | No |
| I858R | −1.30 | 0.11 | −1.37 | 0.10 | −1.32 | 0.24 | No | No |
| I858G | −2.03 | 0.11 | −0.89 | 0.07 | −1.33 | 0.09 | No | No |
| I858L | −0.32 | 0.08 | −0.64 | 0.08 | −0.25 | 0.08 | No | No |
| I858F | −0.53 | 0.17 | −0.64 | 0.17 | NA | NA | Yes | No |
| I858S | −1.55 | 0.16 | −0.66 | 0.12 | NA | NA | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| I858T | −0.49 | 0.13 | −0.72 | 0.13 | −0.26 | 0.20 | No | No |
| I858V | −0.43 | 0.08 | −0.43 | 0.08 | −0.69 | 0.11 | No | No |
| I859A | −2.25 | 0.14 | −1.44 | 0.10 | −0.96 | 0.35 | No | No |
| I859R | −1.46 | 0.08 | −1.27 | 0.07 | −1.13 | 0.07 | No | No |
| I859N | −0.63 | 0.17 | −0.59 | 0.16 | −0.31 | 0.21 | No | No |
| I859D | −1.17 | 0.15 | −1.53 | 0.16 | NA | NA | Yes | No |
| I859Q | −0.35 | 0.17 | 0.41 | 0.15 | NA | NA | Yes | No |
| I859E | −0.25 | 0.09 | −0.09 | 0.08 | −0.48 | 0.11 | No | No |
| I859G | −1.65 | 0.07 | −1.30 | 0.06 | −1.32 | 0.22 | No | No |
| I859L | −0.20 | 0.04 | −0.01 | 0.04 | −0.26 | 0.04 | No | No |
| I859M | −0.66 | 0.12 | 0.38 | 0.10 | −0.64 | 0.11 | Yes | No |
| I859F | −0.18 | 0.12 | −0.15 | 0.12 | −0.59 | 0.12 | No | No |
| I859S | −0.34 | 0.08 | −1.05 | 0.09 | −1.12 | 0.17 | No | No |
| I859T | −0.26 | 0.09 | −0.27 | 0.09 | −0.35 | 0.15 | No | No |
| I859W | −1.84 | 0.15 | −0.31 | 0.09 | −0.74 | 0.64 | No | No |
| I859V | 0.30 | 0.04 | −0.13 | 0.05 | 0.24 | 0.05 | Yes | No |
| K860A | −0.50 | 0.06 | −0.35 | 0.06 | −1.06 | 0.07 | No | No |
| K860R | −0.39 | 0.05 | −0.83 | 0.05 | −0.83 | 0.10 | No | No |
| K860N | −0.63 | 0.12 | −1.47 | 0.14 | −0.88 | 0.16 | No | No |
| K860C | −0.36 | 0.10 | −0.81 | 0.11 | NA | NA | Yes | No |
| K860Q | −0.18 | 0.04 | −0.19 | 0.04 | −0.15 | 0.06 | No | No |
| K860E | −0.89 | 0.06 | −1.15 | 0.07 | −1.08 | 0.05 | No | No |
| K860G | −1.23 | 0.05 | −1.22 | 0.05 | −1.28 | 0.06 | No | No |
| K860L | −0.68 | 0.07 | −1.58 | 0.09 | −1.19 | 0.11 | No | No |
| K860M | −0.24 | 0.09 | −0.56 | 0.09 | −1.00 | 0.15 | No | No |
| K860P | −0.21 | 0.07 | −0.49 | 0.07 | −0.50 | 0.09 | No | No |
| K860S | −1.38 | 0.08 | −1.80 | 0.09 | −1.30 | 0.07 | No | No |
| K860* | −1.43 | 0.12 | −1.23 | 0.11 | −1.17 | 0.16 | No | No |
| K860T | −0.15 | 0.04 | −0.15 | 0.04 | −0.07 | 0.06 | No | No |
| K860W | −1.18 | 0.08 | −1.46 | 0.09 | −1.24 | 0.09 | No | No |
| K860V | −0.88 | 0.06 | −1.87 | 0.08 | −1.03 | 0.04 | No | No |
| D861A | −0.47 | 0.05 | −0.76 | 0.06 | −1.12 | 0.11 | No | No |
| D861R | −1.43 | 0.06 | −1.83 | 0.06 | −1.24 | 0.09 | No | No |
| D861N | −0.46 | 0.10 | −0.59 | 0.10 | −0.60 | 0.17 | No | No |
| D861C | −0.40 | 0.08 | −0.50 | 0.08 | −0.69 | 0.08 | No | No |
| D861Q | −0.65 | 0.11 | 0.09 | 0.09 | NA | NA | Yes | No |
| D861E | −0.97 | 0.07 | −0.89 | 0.06 | −0.50 | 0.12 | No | No |
| D861G | −0.85 | 0.03 | −1.00 | 0.03 | −1.03 | 0.03 | No | No |
| D861H | 0.92 | 0.12 | −0.60 | 0.15 | −0.36 | 0.21 | Yes | No |
| D861L | −0.37 | 0.07 | 0.09 | 0.06 | −0.18 | 0.07 | Yes | No |
| D861K | 0.55 | 0.09 | −1.49 | 0.13 | −1.22 | 0.43 | Yes | No |
| D861M | −0.29 | 0.10 | −0.57 | 0.10 | −0.68 | 0.40 | No | No |
| D861F | −1.05 | 0.15 | −0.55 | 0.13 | −0.22 | 0.12 | No | No |
| D861S | −1.43 | 0.09 | −1.60 | 0.09 | −1.45 | 0.28 | No | No |
| D861W | −0.88 | 0.07 | −0.84 | 0.07 | −0.15 | 0.08 | No | No |
| D861Y | −0.18 | 0.17 | 0.14 | 0.16 | −0.35 | 0.14 | Yes | No |
| D861V | −1.18 | 0.06 | −0.99 | 0.05 | −1.28 | 0.12 | No | No |
| R862K | 0.04 | 0.14 | 0.54 | 0.13 | 0.02 | 0.38 | Yes | Yes |
| R862A | −1.76 | 0.13 | −0.42 | 0.08 | −0.71 | 0.31 | No | No |
| R862C | −0.64 | 0.12 | −1.78 | 0.16 | −0.65 | 0.28 | No | No |
| R862Q | −0.27 | 0.10 | −0.07 | 0.09 | −0.28 | 0.13 | No | No |
| R862E | −0.64 | 0.12 | −1.63 | 0.15 | −0.76 | 0.09 | No | No |
| R862G | −0.72 | 0.05 | −0.83 | 0.05 | −0.85 | 0.07 | No | No |
| R862L | −0.90 | 0.08 | −0.16 | 0.07 | −0.39 | 0.09 | No | No |
| R862M | −1.06 | 0.17 | −0.69 | 0.15 | NA | NA | Yes | No |
| R862P | −1.33 | 0.17 | −1.10 | 0.15 | NA | NA | Yes | No |
| R862W | −1.35 | 0.11 | −0.91 | 0.09 | −1.10 | 0.14 | No | No |
| R862V | NA | NA | NA | NA | −1.61 | 0.43 | Yes | No |
| R863Q | −0.49 | 0.13 | −0.79 | 0.14 | NA | NA | Yes | No |
| R863G | −1.68 | 0.09 | −1.14 | 0.07 | −1.45 | 0.07 | No | No |
| R863L | −1.18 | 0.15 | −1.68 | 0.17 | −1.02 | 0.13 | No | No |
| R863W | −1.27 | 0.11 | −1.06 | 0.10 | −1.17 | 0.14 | No | No |
| F864I | −0.25 | 0.11 | −0.08 | 0.11 | −0.19 | 0.12 | No | No |
| F864L | 0.01 | 0.07 | −0.06 | 0.07 | 0.06 | 0.08 | Yes | No |
| F864S | −0.34 | 0.14 | −0.27 | 0.14 | −0.35 | 0.17 | No | No |
| F864W | −0.66 | 0.18 | −0.77 | 0.18 | NA | NA | Yes | No |
| F864V | −0.11 | 0.06 | −0.13 | 0.05 | 0.00 | 0.08 | No | No |
| T865A | −0.65 | 0.14 | −0.29 | 0.12 | −0.09 | 0.18 | No | No |
| T865N | 0.07 | 0.03 | −0.05 | 0.03 | −0.15 | 0.04 | Yes | No |
| T865I | −0.01 | 0.10 | 0.20 | 0.09 | 0.20 | 0.13 | Yes | No |
| T865L | NA | NA | NA | NA | 0.57 | 0.29 | Yes | No |
| T865P | −0.10 | 0.05 | −0.07 | 0.05 | −0.01 | 0.06 | No | No |
| T865S | −0.20 | 0.02 | −0.20 | 0.02 | 0.01 | 0.03 | Yes | No |
| T865Y | −0.16 | 0.06 | −0.17 | 0.05 | −0.16 | 0.10 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| S866F | 0.00 | 0.13 | 0.06 | 0.12 | 0.10 | 0.14 | Yes | Yes |
| S866T | 0.05 | 0.13 | 0.02 | 0.13 | 0.40 | 0.15 | Yes | Yes |
| S866A | −0.10 | 0.09 | −0.40 | 0.10 | 0.05 | 0.07 | Yes | No |
| S866R | NA | NA | NA | NA | −0.33 | 0.09 | Yes | No |
| S866D | NA | NA | NA | NA | 0.02 | 0.24 | Yes | No |
| S866C | NA | NA | NA | NA | −0.05 | 0.43 | Yes | No |
| S866Q | NA | NA | NA | NA | −0.04 | 0.27 | Yes | No |
| S866E | NA | NA | NA | NA | 0.58 | 0.22 | Yes | No |
| S866G | NA | NA | NA | NA | −0.97 | 0.29 | Yes | No |
| S866L | NA | NA | NA | NA | 0.57 | 0.10 | Yes | No |
| S866M | NA | NA | NA | NA | 0.85 | 0.14 | Yes | No |
| S866P | 0.08 | 0.03 | −0.07 | 0.03 | 0.00 | 0.03 | Yes | No |
| S866W | NA | NA | NA | NA | −0.67 | 0.37 | Yes | No |
| S866Y | 0.13 | 0.16 | −0.17 | 0.17 | 0.03 | 0.11 | Yes | No |
| S866V | NA | NA | NA | NA | 1.00 | 0.08 | Yes | No |
| D867A | 0.05 | 0.02 | −0.05 | 0.02 | −0.05 | 0.02 | Yes | No |
| D867R | NA | NA | NA | NA | −1.39 | 0.06 | Yes | No |
| D867N | NA | NA | NA | NA | −0.17 | 0.14 | Yes | No |
| D867C | NA | NA | NA | NA | −0.98 | 0.17 | Yes | No |
| D867E | −0.16 | 0.11 | −0.21 | 0.11 | −0.99 | 0.09 | No | No |
| D867G | 0.06 | 0.02 | 0.00 | 0.02 | −0.11 | 0.02 | Yes | No |
| D867H | −0.04 | 0.09 | 0.11 | 0.08 | NA | NA | Yes | No |
| D867S | NA | NA | NA | NA | −0.98 | 0.09 | Yes | No |
| D867W | NA | NA | NA | NA | −1.25 | 0.13 | Yes | No |
| D867Y | NA | NA | NA | NA | −1.02 | 0.12 | Yes | No |
| D867V | −0.04 | 0.10 | −0.07 | 0.10 | −0.92 | 0.07 | No | No |
| K868A | NA | NA | NA | NA | −1.23 | 0.28 | Yes | No |
| K868R | −0.01 | 0.02 | 0.02 | 0.02 | −0.76 | 0.04 | Yes | No |
| K868N | NA | NA | NA | NA | −1.00 | 0.11 | Yes | No |
| K868Q | −0.14 | 0.09 | −0.02 | 0.09 | −0.11 | 0.08 | No | No |
| K868E | −0.43 | 0.19 | −0.52 | 0.19 | −1.33 | 0.19 | No | No |
| K868G | NA | NA | NA | NA | −1.49 | 0.08 | Yes | No |
| K868P | NA | NA | NA | NA | −1.00 | 0.09 | Yes | No |
| K868S | NA | NA | NA | NA | −1.32 | 0.15 | Yes | No |
| K868* | NA | NA | NA | NA | −1.02 | 0.18 | Yes | No |
| K868T | −0.15 | 0.03 | −0.12 | 0.03 | −0.14 | 0.07 | No | No |
| K868W | NA | NA | NA | NA | −1.50 | 0.15 | Yes | No |
| K868V | NA | NA | NA | NA | −1.12 | 0.16 | Yes | No |
| F869A | NA | NA | NA | NA | −1.10 | 0.15 | Yes | No |
| F869R | NA | NA | NA | NA | −1.47 | 0.27 | Yes | No |
| F869C | NA | NA | NA | NA | −1.20 | 0.15 | Yes | No |
| F869E | NA | NA | NA | NA | −1.41 | 0.09 | Yes | No |
| F869G | NA | NA | NA | NA | −1.40 | 0.04 | Yes | No |
| F869I | 0.06 | 0.10 | −0.10 | 0.10 | 0.04 | 0.09 | Yes | No |
| F869L | −0.16 | 0.03 | −0.17 | 0.03 | −0.01 | 0.06 | No | No |
| F869M | NA | NA | NA | NA | 0.14 | 0.09 | Yes | No |
| F869S | NA | NA | NA | NA | −1.16 | 0.09 | Yes | No |
| F869W | NA | NA | NA | NA | −1.32 | 0.12 | Yes | No |
| F869Y | NA | NA | NA | NA | −0.21 | 0.24 | Yes | No |
| F869V | −0.16 | 0.05 | −0.18 | 0.05 | −0.62 | 0.05 | No | No |
| L870A | −0.86 | 0.11 | −0.83 | 0.10 | NA | NA | Yes | No |
| L870R | −1.55 | 0.08 | −1.55 | 0.07 | NA | NA | Yes | No |
| L870E | −1.23 | 0.14 | −1.60 | 0.15 | NA | NA | Yes | No |
| L870G | −1.54 | 0.07 | −1.47 | 0.07 | NA | NA | Yes | No |
| L870M | −0.94 | 0.16 | −1.13 | 0.17 | NA | NA | Yes | No |
| L870F | −1.01 | 0.07 | −0.78 | 0.07 | NA | NA | Yes | No |
| L870P | −0.29 | 0.06 | −0.36 | 0.06 | NA | NA | Yes | No |
| L870V | −0.67 | 0.08 | −0.82 | 0.08 | NA | NA | Yes | No |
| F870A | NA | NA | NA | NA | −1.06 | 0.37 | Yes | No |
| F870R | NA | NA | NA | NA | −1.61 | 0.14 | Yes | No |
| F870C | NA | NA | NA | NA | −0.66 | 0.43 | Yes | No |
| F870G | NA | NA | NA | NA | −1.20 | 0.19 | Yes | No |
| F870I | NA | NA | NA | NA | 0.71 | 0.17 | Yes | No |
| F870L | NA | NA | NA | NA | 1.11 | 0.06 | Yes | No |
| F870M | NA | NA | NA | NA | −0.04 | 0.44 | Yes | No |
| F870S | NA | NA | NA | NA | −0.82 | 0.17 | Yes | No |
| F870V | NA | NA | NA | NA | 0.05 | 0.09 | Yes | No |
| F871R | NA | NA | NA | NA | −1.55 | 0.28 | Yes | No |
| F871C | −0.24 | 0.17 | −0.04 | 0.16 | NA | NA | Yes | No |
| F871G | NA | NA | NA | NA | −1.08 | 0.22 | Yes | No |
| F871L | −0.17 | 0.07 | −0.16 | 0.07 | −0.50 | 0.08 | No | No |
| F871S | NA | NA | NA | NA | −0.74 | 0.12 | Yes | No |
| F871V | 0.19 | 0.12 | −0.06 | 0.12 | −0.68 | 0.22 | Yes | No |
| H872R | −0.49 | 0.19 | −0.27 | 0.18 | −1.33 | 0.16 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| H872Q | −0.40 | 0.10 | −0.32 | 0.10 | −0.60 | 0.11 | No | No |
| H872G | NA | NA | NA | NA | −1.61 | 0.11 | Yes | No |
| H872L | 0.00 | 0.08 | −0.15 | 0.08 | −0.43 | 0.08 | No | No |
| H872P | 0.04 | 0.02 | −0.01 | 0.02 | 0.34 | 0.02 | Yes | No |
| H872Y | NA | NA | NA | NA | 0.10 | 0.21 | Yes | No |
| H872V | NA | NA | NA | NA | −1.51 | 0.48 | Yes | No |
| V873A | 0.16 | 0.11 | 0.05 | 0.11 | 0.08 | 0.16 | Yes | Yes |
| V873E | −0.40 | 0.14 | −0.35 | 0.14 | NA | NA | Yes | No |
| V873G | −0.13 | 0.04 | −0.20 | 0.03 | −0.27 | 0.07 | No | No |
| V873L | −0.20 | 0.05 | 0.24 | 0.05 | −0.40 | 0.08 | Yes | No |
| V873M | −0.48 | 0.12 | −0.33 | 0.11 | −0.16 | 0.16 | No | No |
| P874A | −0.12 | 0.06 | 0.06 | 0.06 | 0.03 | 0.11 | Yes | No |
| P874G | NA | NA | NA | NA | −0.22 | 0.17 | Yes | No |
| P874S | −0.06 | 0.10 | −0.17 | 0.10 | 0.58 | 0.11 | Yes | No |
| P874T | −0.23 | 0.06 | −0.24 | 0.06 | −0.09 | 0.04 | No | No |
| I875R | −0.33 | 0.12 | −0.24 | 0.11 | −0.82 | 0.10 | No | No |
| I875N | −0.01 | 0.07 | −0.09 | 0.07 | 0.03 | 0.08 | Yes | No |
| I875G | NA | NA | NA | NA | −1.64 | 0.10 | Yes | No |
| I875H | 0.10 | 0.11 | −0.01 | 0.11 | −0.25 | 0.11 | Yes | No |
| I875L | 0.08 | 0.02 | 0.02 | 0.02 | −0.08 | 0.02 | Yes | No |
| I875M | −0.44 | 0.17 | −0.26 | 0.16 | 0.05 | 0.17 | Yes | No |
| I875F | −0.20 | 0.09 | −0.13 | 0.09 | −0.12 | 0.10 | No | No |
| I875S | −0.06 | 0.07 | −0.04 | 0.07 | −0.22 | 0.07 | No | No |
| I875T | −0.01 | 0.10 | −0.10 | 0.09 | −0.11 | 0.11 | No | No |
| I875V | −0.24 | 0.17 | −0.16 | 0.16 | −0.44 | 0.10 | No | No |
| T876A | NA | NA | NA | NA | −1.21 | 0.20 | Yes | No |
| T876R | NA | NA | NA | NA | −1.72 | 0.26 | Yes | No |
| T876N | −0.10 | 0.03 | −0.09 | 0.03 | −0.07 | 0.05 | No | No |
| T876G | NA | NA | NA | NA | −1.44 | 0.22 | Yes | No |
| T876P | −0.03 | 0.06 | −0.07 | 0.06 | −0.30 | 0.05 | No | No |
| T876S | NA | NA | NA | NA | −0.63 | 0.19 | Yes | No |
| T876V | NA | NA | NA | NA | −1.34 | 0.33 | Yes | No |
| L877A | 0.09 | 0.12 | −0.51 | 0.13 | NA | NA | Yes | No |
| L877R | −0.89 | 0.08 | −1.39 | 0.09 | −1.53 | 0.08 | No | No |
| L877C | −0.26 | 0.17 | −0.47 | 0.17 | NA | NA | Yes | No |
| L877Q | −0.43 | 0.11 | −0.45 | 0.11 | −0.39 | 0.13 | No | No |
| L877G | −1.42 | 0.09 | −2.38 | 0.13 | −1.74 | 0.35 | No | No |
| L877P | −0.08 | 0.07 | −0.22 | 0.07 | −0.40 | 0.12 | No | No |
| L877S | −1.11 | 0.16 | −0.99 | 0.15 | NA | NA | Yes | No |
| L877V | −1.25 | 0.14 | 0.04 | 0.10 | −0.96 | 0.08 | Yes | No |
| L877A | −0.03 | 0.10 | −0.76 | 0.11 | NA | NA | Yes | No |
| L877R | −0.15 | 0.04 | −0.31 | 0.04 | −0.02 | 0.04 | No | No |
| L877C | −0.29 | 0.15 | −0.65 | 0.15 | NA | NA | Yes | No |
| L877Q | −0.26 | 0.11 | −0.47 | 0.11 | NA | NA | Yes | No |
| L877E | NA | NA | NA | NA | −0.74 | 0.64 | Yes | No |
| L877G | −1.40 | 0.08 | −2.82 | 0.12 | −1.79 | 0.22 | No | No |
| L877M | −0.19 | 0.11 | 0.18 | 0.10 | 0.26 | 0.10 | Yes | No |
| L877P | −0.28 | 0.09 | −0.39 | 0.08 | −0.46 | 0.15 | No | No |
| L877S | −1.31 | 0.14 | −1.01 | 0.12 | NA | NA | Yes | No |
| L877V | −1.10 | 0.10 | −0.29 | 0.08 | −0.58 | 0.06 | No | No |
| N878D | 0.03 | 0.06 | 0.02 | 0.06 | 0.04 | 0.08 | Yes | Yes |
| N878A | 0.17 | 0.16 | −0.41 | 0.17 | −0.06 | 0.25 | Yes | No |
| N878Q | −0.22 | 0.17 | −0.53 | 0.17 | NA | NA | Yes | No |
| N878E | −0.73 | 0.15 | −0.44 | 0.13 | −0.84 | 0.13 | No | No |
| N878G | −0.57 | 0.10 | −0.98 | 0.11 | −0.70 | 0.06 | No | No |
| N878H | −0.01 | 0.05 | −0.10 | 0.05 | 0.03 | 0.05 | Yes | No |
| N878L | NA | NA | NA | NA | −0.13 | 0.64 | Yes | No |
| N878K | −0.01 | 0.02 | −0.05 | 0.02 | −0.06 | 0.02 | No | No |
| N878S | −1.08 | 0.15 | −0.43 | 0.12 | −0.38 | 0.10 | No | No |
| N878T | −0.16 | 0.06 | 0.09 | 0.06 | 0.15 | 0.07 | Yes | No |
| N878Y | −0.05 | 0.07 | 0.00 | 0.06 | 0.06 | 0.04 | Yes | No |
| N878V | −1.01 | 0.17 | −0.32 | 0.14 | −0.19 | 0.34 | No | No |
| N878A | 0.03 | 0.14 | −0.32 | 0.14 | −0.19 | 0.54 | Yes | No |
| N878D | −0.11 | 0.12 | −0.34 | 0.12 | −0.62 | 0.15 | No | No |
| N878C | NA | NA | NA | NA | 0.58 | 0.42 | Yes | No |
| N878G | −0.62 | 0.10 | −1.09 | 0.11 | −0.81 | 0.05 | No | No |
| N878I | −0.35 | 0.16 | −0.02 | 0.15 | −0.41 | 0.17 | No | No |
| N878L | NA | NA | NA | NA | −0.12 | 0.82 | Yes | No |
| N878K | −0.34 | 0.13 | −0.40 | 0.13 | −0.39 | 0.08 | No | No |
| N878M | NA | NA | NA | NA | 0.25 | 0.16 | Yes | No |
| N878S | −0.54 | 0.11 | −0.30 | 0.10 | −0.50 | 0.07 | No | No |
| N878T | −0.19 | 0.05 | −0.20 | 0.05 | −0.37 | 0.09 | No | No |
| N878Y | −0.34 | 0.18 | −0.28 | 0.17 | −0.12 | 0.21 | No | No |
| N878V | −0.98 | 0.15 | −0.37 | 0.12 | −0.51 | 0.32 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| Y879A | −2.04 | 0.15 | −1.14 | 0.10 | NA | NA | Yes | No |
| Y879R | −0.78 | 0.08 | −1.40 | 0.08 | −1.48 | 0.11 | No | No |
| Y879D | 0.39 | 0.05 | −0.19 | 0.06 | −0.18 | 0.07 | Yes | No |
| Y879C | 0.50 | 0.06 | −0.02 | 0.07 | −0.50 | 0.09 | Yes | No |
| Y879Q | −0.72 | 0.19 | −0.38 | 0.17 | NA | NA | Yes | No |
| Y879E | −1.40 | 0.13 | −1.23 | 0.11 | NA | NA | Yes | No |
| Y879G | −0.58 | 0.05 | −1.93 | 0.07 | −1.84 | 0.23 | No | No |
| Y879H | 0.35 | 0.09 | 0.04 | 0.09 | −0.16 | 0.12 | Yes | No |
| Y879L | −1.45 | 0.13 | 0.26 | 0.08 | −1.39 | 0.33 | Yes | No |
| Y879K | 0.13 | 0.14 | −1.11 | 0.17 | NA | NA | Yes | No |
| Y879F | −0.05 | 0.12 | −0.01 | 0.11 | 0.01 | 0.17 | Yes | No |
| Y879S | 0.37 | 0.04 | −0.29 | 0.04 | −0.43 | 0.07 | Yes | No |
| Y879* | −0.20 | 0.11 | 0.92 | 0.09 | −0.81 | 0.15 | Yes | No |
| Y879W | −0.05 | 0.08 | −0.07 | 0.07 | 0.60 | 0.07 | Yes | No |
| Y879V | −0.53 | 0.08 | −0.97 | 0.08 | NA | NA | Yes | No |
| Q880R | 0.13 | 0.05 | 0.02 | 0.05 | 0.01 | 0.06 | Yes | Yes |
| Q880G | 0.25 | 0.04 | 0.19 | 0.04 | 0.64 | 0.05 | Yes | Yes |
| Q880A | −0.10 | 0.08 | 0.40 | 0.07 | −0.19 | 0.20 | Yes | No |
| Q880D | 0.81 | 0.14 | −1.10 | 0.18 | NA | NA | Yes | No |
| Q880C | −0.08 | 0.14 | −1.19 | 0.17 | 0.17 | 0.14 | Yes | No |
| Q880E | −0.73 | 0.10 | −1.06 | 0.10 | −0.58 | 0.08 | No | No |
| Q880H | 0.24 | 0.08 | −0.08 | 0.08 | −0.10 | 0.08 | Yes | No |
| Q880L | −0.80 | 0.08 | −0.59 | 0.07 | −1.39 | 0.07 | No | No |
| Q880K | −0.23 | 0.13 | −0.27 | 0.13 | −0.44 | 0.09 | No | No |
| Q880M | −0.93 | 0.16 | −0.77 | 0.14 | −0.49 | 0.17 | No | No |
| Q880P | −0.07 | 0.10 | −0.40 | 0.10 | 0.12 | 0.07 | Yes | No |
| Q880S | −0.31 | 0.09 | −0.76 | 0.10 | −0.09 | 0.07 | No | No |
| Q880* | −1.27 | 0.14 | −0.76 | 0.11 | −1.05 | 0.11 | No | No |
| Q880T | −0.52 | 0.14 | −0.18 | 0.12 | 0.07 | 0.29 | Yes | No |
| Q880W | −0.68 | 0.08 | −0.91 | 0.08 | −0.82 | 0.06 | No | No |
| Q880V | −1.77 | 0.10 | −0.81 | 0.07 | −0.63 | 0.07 | No | No |
| A881R | −0.95 | 0.07 | −1.75 | 0.08 | −1.43 | 0.18 | No | No |
| A881D | −0.36 | 0.11 | −0.32 | 0.10 | −0.48 | 0.19 | No | No |
| A881C | −0.35 | 0.14 | −0.78 | 0.15 | −0.49 | 0.10 | No | No |
| A881G | 0.14 | 0.04 | 0.32 | 0.04 | −0.41 | 0.04 | Yes | No |
| A881L | −1.36 | 0.11 | −2.39 | 0.15 | NA | NA | Yes | No |
| A881P | −1.05 | 0.16 | −0.99 | 0.14 | −0.80 | 0.18 | No | No |
| A881S | 0.13 | 0.05 | 0.13 | 0.05 | −0.13 | 0.06 | Yes | No |
| A881T | −0.73 | 0.10 | −0.95 | 0.10 | −0.44 | 0.14 | No | No |
| A881W | −1.25 | 0.12 | −1.48 | 0.12 | NA | NA | Yes | No |
| A881V | −1.66 | 0.09 | −1.28 | 0.07 | −0.91 | 0.08 | No | No |
| A882D | 0.32 | 0.05 | 0.22 | 0.05 | 0.10 | 0.07 | Yes | Yes |
| A882S | 0.11 | 0.12 | 0.14 | 0.11 | 0.23 | 0.22 | Yes | Yes |
| A882R | −0.10 | 0.10 | 0.54 | 0.09 | 0.51 | 0.35 | Yes | No |
| A882G | −0.43 | 0.07 | −0.32 | 0.06 | −0.14 | 0.06 | No | No |
| A882L | −1.02 | 0.19 | 0.32 | 0.14 | NA | NA | Yes | No |
| A882P | −0.12 | 0.14 | −0.11 | 0.13 | −0.12 | 0.24 | No | No |
| A882T | −0.14 | 0.09 | 0.05 | 0.09 | −0.09 | 0.13 | Yes | No |
| A882V | 0.39 | 0.08 | 0.04 | 0.08 | −0.17 | 0.15 | Yes | No |
| N883G | 0.42 | 0.08 | 0.37 | 0.08 | 0.03 | 0.11 | Yes | Yes |
| N883K | 0.12 | 0.16 | 0.23 | 0.16 | 0.16 | 0.10 | Yes | Yes |
| N883A | −0.26 | 0.15 | −1.10 | 0.17 | 0.05 | 0.55 | Yes | No |
| N883R | NA | NA | NA | NA | 0.84 | 0.11 | Yes | No |
| N883D | −0.02 | 0.13 | −0.37 | 0.14 | −0.36 | 0.18 | No | No |
| N883I | 0.00 | 0.16 | 0.08 | 0.15 | −0.37 | 0.12 | Yes | No |
| N883S | 0.08 | 0.10 | 0.04 | 0.10 | −0.13 | 0.09 | Yes | No |
| N883T | 0.27 | 0.11 | −0.02 | 0.11 | −0.21 | 0.12 | Yes | No |
| S884V | 0.05 | 0.11 | 0.61 | 0.10 | 0.03 | 0.14 | Yes | Yes |
| S884A | 0.07 | 0.13 | −0.01 | 0.12 | 0.02 | NA | Yes | No |
| S884R | −0.28 | 0.06 | −0.11 | 0.06 | 0.34 | 0.07 | Yes | No |
| S884N | 0.14 | 0.14 | 0.48 | 0.13 | −0.07 | 0.25 | Yes | No |
| S884C | NA | NA | NA | NA | 0.18 | 0.19 | Yes | No |
| S884E | −0.10 | 0.16 | −0.04 | 0.15 | NA | NA | Yes | No |
| S884G | −0.09 | 0.06 | −0.11 | 0.06 | 0.01 | 0.10 | Yes | No |
| S884L | NA | NA | NA | NA | 0.02 | 0.55 | Yes | No |
| S884T | −0.01 | 0.10 | 0.05 | 0.10 | NA | NA | Yes | No |
| S884W | −0.99 | 0.18 | −0.38 | 0.14 | 0.43 | 0.82 | Yes | No |
| P885A | −0.36 | 0.06 | −0.32 | 0.05 | −0.12 | 0.13 | No | No |
| P885R | −0.03 | 0.04 | −0.89 | 0.05 | 0.00 | 0.06 | Yes | No |
| P885N | −0.47 | 0.17 | −0.73 | 0.17 | NA | NA | Yes | No |
| P885D | −0.73 | 0.12 | −1.21 | 0.12 | −0.83 | 0.35 | No | No |
| P885C | −1.54 | 0.14 | −0.39 | 0.09 | −0.01 | 0.09 | No | No |
| P885Q | −1.26 | 0.18 | −0.04 | 0.13 | −0.65 | 0.33 | No | No |
| P885E | −0.08 | 0.08 | −1.01 | 0.09 | −0.98 | 0.16 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| P885G | −1.22 | 0.05 | −0.98 | 0.04 | −0.39 | 0.04 | No | No |
| P885H | −0.06 | 0.13 | −0.41 | 0.13 | 0.09 | 0.12 | Yes | No |
| P885I | NA | NA | NA | NA | −0.01 | 0.44 | Yes | No |
| P885L | −0.66 | 0.07 | −0.90 | 0.07 | −0.60 | 0.05 | No | No |
| P885K | −0.12 | 0.12 | −0.28 | 0.12 | −0.32 | 0.22 | No | No |
| P885M | −1.32 | 0.15 | −1.01 | 0.13 | −0.52 | 0.13 | No | No |
| P885F | −0.98 | 0.16 | −0.49 | 0.14 | −0.31 | 0.10 | No | No |
| P885S | −0.88 | 0.07 | −0.65 | 0.06 | −0.11 | 0.12 | No | No |
| P885T | −0.35 | 0.04 | −0.29 | 0.04 | 0.03 | 0.05 | Yes | No |
| P885W | −0.76 | 0.07 | −1.20 | 0.08 | −0.94 | 0.23 | No | No |
| P885Y | −0.19 | 0.16 | 0.72 | 0.13 | 0.22 | 0.48 | Yes | No |
| P885V | −0.86 | 0.06 | −0.46 | 0.05 | 0.05 | 0.12 | Yes | No |
| S886L | 0.09 | 0.08 | 0.12 | 0.08 | 0.05 | 0.11 | Yes | Yes |
| S886M | 0.32 | 0.11 | 0.15 | 0.11 | 0.40 | 0.35 | Yes | Yes |
| S886W | 0.23 | 0.07 | 0.01 | 0.07 | 0.70 | 0.19 | Yes | Yes |
| S886A | −0.52 | 0.07 | −0.42 | 0.07 | −0.04 | 0.14 | No | No |
| S886R | 0.12 | 0.04 | −0.08 | 0.04 | 0.36 | 0.04 | Yes | No |
| S886N | 0.34 | 0.10 | −0.34 | 0.11 | −0.03 | 0.14 | Yes | No |
| S886D | 0.60 | 0.10 | −0.69 | 0.12 | NA | NA | Yes | No |
| S886C | 0.11 | 0.09 | −0.64 | 0.09 | 0.34 | 0.23 | Yes | No |
| S886Q | −0.33 | 0.14 | −0.65 | 0.14 | 0.19 | 0.64 | Yes | No |
| S886E | −0.60 | 0.10 | −0.56 | 0.10 | NA | NA | Yes | No |
| S886G | −0.20 | 0.04 | −0.18 | 0.04 | 0.10 | 0.05 | Yes | No |
| S886I | 0.89 | 0.13 | −0.13 | 0.14 | 0.07 | 0.29 | Yes | No |
| S886K | −0.70 | 0.14 | 0.01 | 0.12 | 0.56 | 0.12 | Yes | No |
| S886F | NA | NA | NA | NA | 0.75 | 0.44 | Yes | No |
| S886P | NA | NA | NA | NA | −0.28 | 0.14 | Yes | No |
| S886T | 0.07 | 0.07 | −0.05 | 0.07 | −0.29 | 0.10 | Yes | No |
| S886Y | NA | NA | NA | NA | 0.79 | 0.55 | Yes | No |
| S886V | −0.10 | 0.07 | −0.15 | 0.06 | 0.35 | 0.20 | Yes | No |
| K887A | 0.03 | 0.04 | −0.38 | 0.05 | −0.54 | 0.04 | Yes | No |
| K887R | −0.09 | 0.03 | −0.04 | 0.03 | 0.21 | 0.03 | Yes | No |
| K887N | 0.24 | 0.10 | 0.07 | 0.10 | −0.45 | 0.24 | Yes | No |
| K887D | −1.19 | 0.10 | −0.97 | 0.09 | −1.27 | 0.28 | No | No |
| K887C | −0.76 | 0.08 | 0.16 | 0.07 | −0.59 | 0.06 | Yes | No |
| K887Q | 0.10 | 0.08 | −0.05 | 0.07 | −0.25 | 0.11 | Yes | No |
| K887E | −0.33 | 0.05 | −0.39 | 0.05 | −0.97 | 0.06 | No | No |
| K887G | −0.14 | 0.03 | −0.22 | 0.02 | −0.42 | 0.03 | No | No |
| K887H | −0.04 | 0.12 | −1.21 | 0.15 | −0.21 | 0.40 | No | No |
| K887I | −0.31 | 0.12 | −0.04 | 0.11 | NA | NA | Yes | No |
| K887L | −0.88 | 0.06 | −0.67 | 0.05 | −0.68 | 0.07 | No | No |
| K887M | −0.12 | 0.07 | −0.23 | 0.07 | −0.44 | 0.16 | No | No |
| K887F | 0.22 | 0.11 | −0.22 | 0.11 | −0.74 | 0.25 | Yes | No |
| K887P | −0.29 | 0.08 | −0.61 | 0.08 | −0.32 | 0.18 | No | No |
| K887S | −0.03 | 0.05 | −0.50 | 0.05 | −0.66 | 0.08 | No | No |
| K887* | −0.88 | 0.08 | −1.30 | 0.08 | −1.22 | 0.10 | No | No |
| K887T | −0.79 | 0.08 | −0.22 | 0.07 | −0.74 | 0.11 | No | No |
| K887W | −0.59 | 0.05 | −0.69 | 0.05 | −0.65 | 0.07 | No | No |
| K887Y | 0.36 | 0.10 | −0.98 | 0.13 | −0.40 | 0.17 | Yes | No |
| K887V | 0.09 | 0.04 | −0.88 | 0.04 | −0.89 | 0.07 | Yes | No |
| F888A | −2.01 | 0.10 | −1.31 | 0.07 | −1.30 | 0.28 | No | No |
| F888R | −1.27 | 0.07 | −1.04 | 0.06 | −1.82 | 0.18 | No | No |
| F888D | −1.09 | 0.12 | −1.32 | 0.12 | NA | NA | Yes | No |
| F888C | 0.01 | 0.04 | −0.10 | 0.04 | 0.10 | 0.03 | Yes | No |
| F888Q | −0.58 | 0.13 | −1.37 | 0.15 | NA | NA | Yes | No |
| F888E | −0.89 | 0.08 | −2.09 | 0.11 | −1.77 | 0.12 | No | No |
| F888G | −1.75 | 0.05 | −1.53 | 0.05 | −1.57 | 0.03 | No | No |
| F888I | 0.09 | 0.11 | −0.24 | 0.11 | −0.50 | 0.15 | Yes | No |
| F888L | −0.13 | 0.04 | −0.06 | 0.03 | −0.23 | 0.05 | No | No |
| F888M | −0.65 | 0.12 | 0.31 | 0.10 | −0.04 | 0.10 | Yes | No |
| F888P | −0.69 | 0.12 | −1.56 | 0.15 | NA | NA | Yes | No |
| F888S | −1.42 | 0.08 | −1.17 | 0.07 | −1.14 | 0.12 | No | No |
| F888* | −1.06 | 0.13 | −0.77 | 0.11 | −1.31 | 0.08 | No | No |
| F888T | −0.62 | 0.11 | −1.69 | 0.13 | −1.19 | 0.64 | No | No |
| F888W | −1.15 | 0.08 | −2.14 | 0.11 | −1.37 | 0.05 | No | No |
| F888Y | −0.73 | 0.13 | −1.27 | 0.14 | −0.60 | 0.12 | No | No |
| F888V | 0.07 | 0.04 | 0.10 | 0.04 | −0.31 | 0.03 | Yes | No |
| N889A | NA | NA | NA | NA | −0.86 | 0.64 | Yes | No |
| N889R | −0.94 | 0.09 | −0.07 | 0.07 | −0.55 | 0.48 | No | No |
| N889D | −0.34 | 0.10 | −0.44 | 0.10 | −0.39 | 0.14 | No | No |
| N889G | −0.87 | 0.06 | −1.32 | 0.07 | −0.83 | 0.07 | No | No |
| N889I | −0.51 | 0.17 | −0.43 | 0.16 | NA | NA | Yes | No |
| N889K | −0.76 | 0.17 | −0.47 | 0.15 | −0.34 | 0.24 | No | No |
| N889S | −1.13 | 0.11 | 0.08 | 0.08 | −0.26 | 0.14 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| N889T | −0.55 | 0.16 | −0.45 | 0.14 | −0.36 | 0.30 | No | No |
| N889V | −1.82 | 0.15 | −1.28 | 0.12 | −1.16 | 0.64 | No | No |
| Q890C | 0.03 | 0.11 | 0.64 | 0.10 | 0.08 | 0.54 | Yes | Yes |
| Q890H | 0.39 | 0.09 | 0.07 | 0.09 | 0.04 | 0.11 | Yes | Yes |
| Q890W | 0.03 | 0.08 | 0.23 | 0.07 | 0.03 | 0.08 | Yes | Yes |
| Q890A | 0.39 | 0.06 | 0.05 | 0.06 | −0.02 | 0.11 | Yes | No |
| Q890R | −0.10 | 0.05 | −0.24 | 0.05 | −0.05 | 0.10 | No | No |
| Q890N | −0.25 | 0.15 | −0.66 | 0.16 | 0.31 | NA | Yes | No |
| Q890D | 0.54 | 0.10 | −0.52 | 0.11 | −0.35 | 0.20 | Yes | No |
| Q890E | 0.17 | 0.06 | −0.62 | 0.07 | −0.33 | 0.06 | Yes | No |
| Q890G | −0.35 | 0.04 | −0.60 | 0.04 | −0.15 | 0.07 | No | No |
| Q890I | −0.26 | 0.16 | −0.94 | 0.18 | NA | NA | Yes | No |
| Q890L | 0.09 | 0.06 | −0.14 | 0.06 | 0.29 | 0.17 | Yes | No |
| Q890K | 0.23 | 0.10 | 0.25 | 0.10 | −0.22 | 0.16 | Yes | No |
| Q890M | 0.32 | 0.11 | −0.13 | 0.11 | −0.07 | 0.48 | Yes | No |
| Q890F | 0.25 | 0.15 | −0.11 | 0.15 | 0.09 | 0.82 | Yes | No |
| Q890P | −1.20 | 0.12 | −0.75 | 0.10 | −0.11 | 0.17 | No | No |
| Q890S | −0.58 | 0.08 | −0.01 | 0.07 | −0.19 | 0.08 | No | No |
| Q890* | −1.12 | 0.11 | −1.26 | 0.11 | −0.88 | 0.13 | No | No |
| Q890T | −0.36 | 0.10 | 0.11 | 0.09 | 0.08 | 0.09 | Yes | No |
| Q890Y | NA | NA | NA | NA | 0.03 | 0.13 | Yes | No |
| Q890V | −0.39 | 0.06 | −0.33 | 0.06 | 0.21 | 0.06 | Yes | No |
| R891A | −0.41 | 0.08 | −0.46 | 0.07 | −0.44 | 0.31 | No | No |
| R891D | −1.17 | 0.16 | −0.76 | 0.14 | −0.63 | 0.64 | No | No |
| R891C | −0.10 | 0.10 | −0.56 | 0.11 | −0.05 | 0.17 | No | No |
| R891Q | NA | NA | NA | NA | −0.08 | 0.64 | Yes | No |
| R891E | −1.06 | 0.11 | −0.65 | 0.09 | −0.59 | 0.64 | No | No |
| R891G | −0.70 | 0.04 | −0.40 | 0.04 | −0.11 | 0.04 | No | No |
| R891L | 0.07 | 0.08 | −0.02 | 0.08 | −0.25 | 0.33 | Yes | No |
| R891K | −0.04 | 0.11 | −0.37 | 0.11 | −0.03 | 0.26 | No | No |
| R891M | NA | NA | NA | NA | −0.14 | NA | Yes | No |
| R891S | −0.18 | 0.07 | −0.49 | 0.07 | −0.28 | 0.08 | No | No |
| R891* | −0.88 | 0.13 | −0.57 | 0.11 | −0.74 | 0.20 | No | No |
| R891T | −0.20 | 0.10 | −0.28 | 0.10 | −0.16 | 0.10 | No | No |
| R891W | −1.03 | 0.08 | −1.42 | 0.08 | −0.78 | 0.43 | No | No |
| R891V | −0.28 | 0.07 | −0.77 | 0.07 | −0.53 | 0.09 | No | No |
| V892A | −1.02 | 0.08 | −1.08 | 0.08 | −0.18 | 0.07 | No | No |
| V892R | −1.49 | 0.09 | −1.55 | 0.08 | −1.41 | 0.09 | No | No |
| V892C | −0.58 | 0.14 | −0.80 | 0.14 | −0.01 | 0.13 | No | No |
| V892E | −0.97 | 0.10 | −1.28 | 0.10 | −0.93 | 0.17 | No | No |
| V892G | −1.01 | 0.05 | −1.11 | 0.05 | −0.90 | 0.05 | No | No |
| V892L | −0.58 | 0.09 | −1.35 | 0.10 | −0.93 | 0.14 | No | No |
| V892M | −0.59 | 0.12 | −0.62 | 0.12 | NA | NA | Yes | No |
| V892S | −1.15 | 0.13 | −1.21 | 0.12 | NA | NA | Yes | No |
| V892T | −0.34 | 0.15 | 0.05 | 0.13 | 0.11 | 0.64 | Yes | No |
| V892W | −1.99 | 0.15 | −1.09 | 0.10 | NA | NA | Yes | No |
| N893A | −1.02 | 0.07 | −0.18 | 0.05 | −0.37 | 0.05 | No | No |
| N893R | −0.35 | 0.04 | −0.57 | 0.04 | −0.42 | 0.06 | No | No |
| N893D | −0.71 | 0.10 | −0.39 | 0.08 | −0.71 | 0.11 | No | No |
| N893C | −0.80 | 0.10 | −0.20 | 0.09 | −0.24 | 0.07 | No | No |
| N893Q | −1.58 | 0.15 | −0.86 | 0.11 | −0.57 | 0.20 | No | No |
| N893E | −0.89 | 0.07 | −1.03 | 0.07 | −1.10 | 0.10 | No | No |
| N893G | −0.30 | 0.03 | −0.68 | 0.03 | −0.34 | 0.04 | No | No |
| N893H | 0.02 | 0.13 | −0.74 | 0.14 | NA | NA | Yes | No |
| N893I | 0.33 | 0.11 | −0.24 | 0.12 | −0.68 | 0.11 | Yes | No |
| N893L | −1.03 | 0.08 | −0.46 | 0.07 | −0.86 | 0.17 | No | No |
| N893K | −0.39 | 0.07 | −0.07 | 0.06 | −0.27 | 0.07 | No | No |
| N893M | 0.26 | 0.08 | −0.81 | 0.10 | −1.04 | 0.33 | Yes | No |
| N893S | 0.64 | 0.05 | 0.08 | 0.05 | −0.47 | 0.06 | Yes | No |
| N893* | −1.54 | 0.12 | −1.43 | 0.11 | −1.26 | 0.17 | No | No |
| N893T | 1.09 | 0.06 | −0.04 | 0.06 | −0.62 | 0.08 | Yes | No |
| N893W | −0.63 | 0.06 | −0.48 | 0.06 | −0.78 | 0.10 | No | No |
| N893Y | −0.51 | 0.12 | −0.87 | 0.12 | −0.38 | 0.18 | No | No |
| N893V | −0.70 | 0.06 | −0.74 | 0.06 | −0.59 | 0.05 | No | No |
| A894R | 0.19 | 0.06 | 0.06 | 0.06 | 0.04 | 0.08 | Yes | Yes |
| A894D | 0.04 | 0.06 | 0.09 | 0.06 | 0.21 | 0.05 | Yes | Yes |
| A894C | −0.13 | 0.15 | −0.29 | 0.14 | NA | NA | Yes | No |
| A894Q | 0.87 | 0.14 | −0.47 | 0.16 | NA | NA | Yes | No |
| A894E | −0.35 | 0.10 | −0.85 | 0.10 | −0.45 | 0.20 | No | No |
| A894G | −0.47 | 0.05 | 0.09 | 0.05 | 0.21 | 0.06 | Yes | No |
| A894L | −0.45 | 0.11 | 0.57 | 0.09 | 0.08 | 0.12 | Yes | No |
| A894K | NA | NA | NA | NA | 0.27 | 0.15 | Yes | No |
| A894M | 0.14 | 0.13 | −0.17 | 0.13 | 0.25 | 0.18 | Yes | No |
| A894P | −0.67 | 0.14 | −1.05 | 0.15 | NA | NA | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| A894S | 0.57 | 0.08 | −0.97 | 0.10 | 0.12 | 0.23 | Yes | No |
| A894* | −0.76 | 0.19 | 0.06 | 0.16 | NA | NA | Yes | No |
| A894T | −0.68 | 0.10 | −0.49 | 0.09 | 0.21 | 0.15 | Yes | No |
| A894W | 0.67 | 0.09 | −0.44 | 0.10 | 0.02 | 0.54 | Yes | No |
| A894V | −0.22 | 0.07 | −0.05 | 0.06 | 0.12 | 0.18 | Yes | No |
| Y895D | 0.16 | 0.04 | 0.00 | 0.04 | 0.09 | 0.04 | Yes | Yes |
| Y895A | −1.08 | 0.12 | −0.85 | 0.11 | −0.53 | 0.37 | No | No |
| Y895R | NA | NA | NA | NA | −0.75 | 0.07 | Yes | No |
| Y895N | −0.12 | 0.11 | −0.43 | 0.11 | −0.07 | 0.23 | No | No |
| Y895C | 0.61 | 0.06 | 0.14 | 0.06 | −0.26 | 0.07 | Yes | No |
| Y895E | −0.53 | 0.11 | −0.74 | 0.10 | −0.62 | 0.13 | No | No |
| Y895G | −0.59 | 0.06 | −1.69 | 0.08 | −1.72 | 0.07 | No | No |
| Y895H | −0.21 | 0.10 | −0.10 | 0.10 | −0.25 | 0.16 | No | No |
| Y895F | 0.70 | 0.12 | −0.28 | 0.13 | −0.20 | 0.21 | Yes | No |
| Y895S | 0.18 | 0.05 | −0.17 | 0.05 | −0.12 | 0.06 | Yes | No |
| Y895* | −0.03 | 0.05 | −0.04 | 0.05 | 0.16 | 0.06 | Yes | No |
| Y895W | −0.08 | 0.11 | 0.17 | 0.10 | −0.18 | 0.31 | Yes | No |
| Y895V | −1.60 | 0.12 | −0.11 | 0.08 | −0.61 | 0.40 | No | No |
| L896A | −1.48 | 0.09 | −1.26 | 0.08 | −1.68 | 0.35 | No | No |
| L896R | 0.19 | 0.04 | −0.11 | 0.04 | −0.30 | 0.04 | Yes | No |
| L896Q | 0.42 | 0.04 | 0.08 | 0.04 | −0.17 | 0.05 | Yes | No |
| L896E | −1.31 | 0.11 | −1.65 | 0.12 | NA | NA | Yes | No |
| L896G | −2.17 | 0.07 | −1.66 | 0.05 | −1.77 | 0.05 | No | No |
| L896M | 0.31 | 0.11 | −0.22 | 0.11 | −0.74 | 0.17 | Yes | No |
| L896F | −0.69 | 0.18 | −0.97 | 0.18 | NA | NA | Yes | No |
| L896P | −0.37 | 0.08 | −0.52 | 0.08 | −0.53 | 0.10 | No | No |
| L896S | NA | NA | NA | NA | −1.38 | 0.48 | Yes | No |
| L896W | −1.69 | 0.12 | −1.64 | 0.11 | −0.97 | 0.54 | No | No |
| L896V | −0.04 | 0.06 | −0.69 | 0.06 | −0.81 | 0.07 | No | No |
| K897A | −0.76 | 0.08 | −0.22 | 0.07 | −0.07 | 0.15 | No | No |
| K897R | 0.03 | 0.04 | −0.01 | 0.04 | −0.05 | 0.05 | Yes | No |
| K897N | 0.58 | 0.11 | 0.26 | 0.11 | −0.06 | 0.09 | Yes | No |
| K897D | −1.39 | 0.13 | −0.61 | 0.10 | −0.10 | 0.25 | No | No |
| K897C | 0.02 | 0.09 | −0.54 | 0.10 | −0.11 | 0.08 | Yes | No |
| K897Q | −0.06 | 0.10 | 0.16 | 0.10 | −0.04 | 0.21 | Yes | No |
| K897E | 0.17 | 0.05 | −0.03 | 0.05 | −0.29 | 0.08 | Yes | No |
| K897G | 0.01 | 0.04 | −0.29 | 0.04 | −0.07 | 0.03 | Yes | No |
| K897H | −0.18 | 0.15 | 0.06 | 0.14 | 0.22 | 0.36 | Yes | No |
| K897I | −0.29 | 0.13 | −1.02 | 0.14 | −0.06 | 0.06 | No | No |
| K897L | −0.19 | 0.07 | −0.26 | 0.07 | 0.28 | 0.35 | Yes | No |
| K897M | −0.35 | 0.09 | −0.01 | 0.08 | 0.23 | 0.11 | Yes | No |
| K897F | −0.72 | 0.18 | 0.16 | 0.15 | −0.08 | 0.64 | Yes | No |
| K897P | −1.22 | 0.13 | −1.78 | 0.14 | NA | NA | Yes | No |
| K897S | −0.22 | 0.07 | −0.29 | 0.07 | −0.13 | 0.10 | No | No |
| K897* | −0.92 | 0.11 | −0.93 | 0.11 | −0.93 | 0.11 | No | No |
| K897T | 0.27 | 0.08 | −0.32 | 0.08 | −0.02 | 0.06 | Yes | No |
| K897W | −0.08 | 0.07 | −0.54 | 0.07 | 0.00 | 0.19 | No | No |
| K897Y | −0.95 | 0.19 | 0.19 | 0.14 | −0.23 | 0.13 | Yes | No |
| K897V | −0.30 | 0.05 | −0.29 | 0.05 | 0.19 | 0.07 | Yes | No |
| E898A | −0.19 | 0.06 | 0.08 | 0.06 | −0.25 | 0.07 | Yes | No |
| E898R | −0.44 | 0.07 | −0.49 | 0.07 | −0.10 | 0.31 | No | No |
| E898D | 0.42 | 0.10 | −0.32 | 0.11 | −0.12 | 0.16 | Yes | No |
| E898C | NA | NA | NA | NA | 0.23 | 0.15 | Yes | No |
| E898Q | −0.43 | 0.14 | −0.57 | 0.13 | 0.29 | 0.39 | Yes | No |
| E898G | −0.27 | 0.05 | −0.27 | 0.05 | 0.12 | 0.06 | Yes | No |
| E898L | 0.07 | 0.11 | −0.46 | 0.12 | 0.15 | 0.12 | Yes | No |
| E898K | −0.93 | 0.16 | −0.35 | 0.14 | 0.13 | 0.31 | Yes | No |
| E898P | −0.40 | 0.19 | −0.60 | 0.19 | NA | NA | Yes | No |
| E898S | 0.17 | 0.14 | −1.32 | 0.18 | 0.38 | 0.55 | Yes | No |
| E898W | −1.01 | 0.12 | −1.33 | 0.12 | −0.16 | 0.14 | No | No |
| E898V | −0.06 | 0.07 | 0.31 | 0.07 | 0.01 | 0.07 | Yes | No |
| H899A | 0.21 | 0.08 | 0.16 | 0.07 | 0.01 | 0.48 | Yes | Yes |
| H899N | 0.15 | 0.15 | 0.70 | 0.14 | 0.08 | 0.18 | Yes | Yes |
| H899R | −0.20 | 0.04 | −0.12 | 0.04 | −0.12 | 0.03 | No | No |
| H899D | −0.84 | 0.13 | −0.16 | 0.11 | −0.47 | 0.25 | No | No |
| H899C | −0.98 | 0.14 | −0.02 | 0.11 | −0.12 | 0.13 | No | No |
| H899Q | −0.15 | 0.05 | −0.20 | 0.05 | 0.00 | 0.03 | No | No |
| H899E | −0.85 | 0.10 | −0.64 | 0.09 | −0.36 | 0.27 | No | No |
| H899G | −0.79 | 0.05 | −0.96 | 0.05 | −0.65 | 0.05 | No | No |
| H899L | −0.27 | 0.08 | −0.41 | 0.08 | −0.50 | 0.14 | No | No |
| H899K | NA | NA | NA | NA | 0.05 | 0.49 | Yes | No |
| H899P | −0.07 | 0.07 | 0.01 | 0.07 | −0.33 | 0.10 | Yes | No |
| H899S | −0.31 | 0.10 | −0.33 | 0.09 | 0.07 | 0.32 | Yes | No |
| H899T | −0.37 | 0.15 | −0.14 | 0.14 | −0.03 | 0.48 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| H899W | −0.32 | 0.08 | −0.24 | 0.07 | −0.25 | 0.48 | No | No |
| H899Y | −0.09 | 0.12 | −0.87 | 0.13 | 0.11 | 0.16 | Yes | No |
| H899V | −0.07 | 0.07 | −0.99 | 0.08 | 0.05 | 0.22 | Yes | No |
| P900A | −0.09 | 0.05 | 0.03 | 0.04 | 0.04 | 0.11 | Yes | No |
| P900R | −0.17 | 0.04 | −0.23 | 0.03 | 0.09 | 0.04 | Yes | No |
| P900N | −1.13 | 0.14 | 0.05 | 0.11 | 0.35 | 0.30 | Yes | No |
| P900D | −0.42 | 0.08 | −0.19 | 0.07 | 0.19 | 0.12 | Yes | No |
| P900C | −0.28 | 0.07 | 0.15 | 0.06 | 0.12 | 0.15 | Yes | No |
| P900Q | 0.28 | 0.08 | −0.19 | 0.09 | 0.23 | 0.30 | Yes | No |
| P900E | −0.19 | 0.06 | 0.18 | 0.05 | 0.29 | 0.08 | Yes | No |
| P900G | −0.03 | 0.03 | −0.15 | 0.03 | 0.11 | 0.03 | Yes | No |
| P900H | 0.07 | 0.08 | −0.18 | 0.08 | 0.25 | 0.12 | Yes | No |
| P900I | −0.83 | 0.12 | −0.36 | 0.10 | 0.33 | 0.33 | Yes | No |
| P900L | 0.03 | 0.04 | −0.20 | 0.04 | 0.07 | 0.04 | Yes | No |
| P900K | 0.16 | 0.08 | −0.61 | 0.08 | 0.05 | 0.13 | Yes | No |
| P900M | −1.26 | 0.10 | −0.21 | 0.07 | 0.06 | 0.12 | Yes | No |
| P900F | 0.33 | 0.10 | −0.07 | 0.10 | −0.19 | 0.09 | Yes | No |
| P900S | −0.10 | 0.05 | 0.15 | 0.04 | 0.14 | 0.04 | Yes | No |
| P900* | −0.32 | 0.08 | −1.30 | 0.10 | NA | NA | Yes | No |
| P900T | 0.24 | 0.06 | −0.22 | 0.06 | 0.19 | 0.09 | Yes | No |
| P900W | −0.16 | 0.05 | −0.48 | 0.06 | −0.04 | 0.06 | No | No |
| P900Y | −0.49 | 0.11 | −0.86 | 0.11 | −0.25 | 0.82 | No | No |
| P900V | 0.10 | 0.04 | −0.35 | 0.04 | 0.14 | 0.05 | Yes | No |
| E901D | 0.07 | 0.10 | 0.05 | 0.10 | 0.14 | 0.15 | Yes | Yes |
| E901A | −0.81 | 0.08 | 0.24 | 0.07 | 0.08 | 0.08 | Yes | No |
| E901R | −0.15 | 0.06 | −0.19 | 0.06 | −0.03 | 0.06 | No | No |
| E901C | −0.08 | 0.13 | −0.32 | 0.13 | 0.21 | 0.64 | Yes | No |
| E901Q | −0.69 | 0.16 | 0.04 | 0.13 | −0.16 | 0.40 | Yes | No |
| E901G | −0.44 | 0.04 | 0.07 | 0.04 | 0.10 | 0.06 | Yes | No |
| E901L | −0.12 | 0.08 | −0.80 | 0.09 | −0.13 | 0.20 | No | No |
| E901K | −0.11 | 0.10 | 0.20 | 0.10 | 0.08 | 0.13 | Yes | No |
| E901M | 0.16 | 0.12 | −0.14 | 0.12 | 0.03 | 0.82 | Yes | No |
| E901P | −0.99 | 0.19 | −1.23 | 0.19 | NA | NA | Yes | No |
| E901S | −1.40 | 0.13 | 0.16 | 0.08 | 0.05 | 0.11 | Yes | No |
| E901* | −0.29 | 0.13 | −1.11 | 0.15 | −0.63 | 0.14 | No | No |
| E901T | NA | NA | NA | NA | −0.05 | 0.44 | Yes | No |
| E901W | 0.02 | 0.08 | −0.49 | 0.09 | 0.21 | 0.08 | Yes | No |
| E901V | −1.13 | 0.07 | −0.49 | 0.06 | 0.11 | 0.06 | Yes | No |
| T902A | −0.07 | 0.05 | −0.35 | 0.05 | −0.20 | 0.09 | No | No |
| T902R | −0.60 | 0.06 | −1.09 | 0.07 | −0.48 | 0.12 | No | No |
| T902C | 0.17 | 0.11 | −0.55 | 0.12 | −0.25 | 0.82 | Yes | No |
| T902Q | −0.92 | 0.15 | −0.24 | 0.13 | NA | NA | Yes | No |
| T902E | −0.55 | 0.10 | −1.12 | 0.11 | NA | NA | Yes | No |
| T902G | −1.03 | 0.06 | −1.00 | 0.06 | −0.74 | 0.15 | No | No |
| T902I | −0.22 | 0.14 | 0.19 | 0.12 | −0.10 | 0.20 | Yes | No |
| T902L | −0.92 | 0.11 | −0.09 | 0.09 | −0.12 | 0.09 | No | No |
| T902K | −0.31 | 0.04 | −0.01 | 0.04 | 0.13 | 0.06 | Yes | No |
| T902M | NA | NA | NA | NA | 0.01 | 0.54 | Yes | No |
| T902P | −1.06 | 0.13 | −0.32 | 0.10 | −0.81 | 0.21 | No | No |
| T902S | −0.15 | 0.07 | −0.38 | 0.07 | −0.15 | 0.07 | No | No |
| T902W | NA | NA | NA | NA | −0.80 | 0.54 | Yes | No |
| T902V | −0.15 | 0.07 | 0.06 | 0.07 | −0.03 | 0.14 | Yes | No |
| P903T | 0.64 | 0.13 | 0.52 | 0.12 | 0.39 | 0.18 | Yes | Yes |
| P903A | −0.22 | 0.11 | −0.37 | 0.10 | −0.12 | 0.31 | No | No |
| P903R | −1.86 | 0.13 | −0.87 | 0.09 | −0.31 | 0.27 | No | No |
| P903C | 0.75 | 0.15 | −0.71 | 0.18 | NA | NA | Yes | No |
| P903E | NA | NA | NA | NA | 0.05 | 0.22 | Yes | No |
| P903G | −1.37 | 0.10 | −1.66 | 0.10 | −0.49 | 0.35 | No | No |
| P903H | NA | NA | NA | NA | 0.04 | 0.17 | Yes | No |
| P903L | −0.52 | 0.11 | −0.93 | 0.12 | 0.29 | 0.10 | Yes | No |
| P903S | −0.61 | 0.12 | 0.03 | 0.10 | 0.07 | 0.22 | Yes | No |
| P903V | −0.44 | 0.12 | −0.77 | 0.12 | 0.25 | 0.16 | Yes | No |
| I904A | 0.28 | 0.05 | 0.32 | 0.05 | −0.01 | 0.10 | Yes | No |
| I904R | −0.52 | 0.05 | −0.28 | 0.04 | −0.14 | 0.04 | No | No |
| I904N | −0.26 | 0.11 | 0.07 | 0.10 | −0.29 | 0.13 | Yes | No |
| I904D | NA | NA | NA | NA | −1.33 | 0.37 | Yes | No |
| I904C | −0.37 | 0.09 | −0.06 | 0.08 | 0.16 | 0.09 | Yes | No |
| I904Q | −0.28 | 0.11 | 0.17 | 0.10 | 0.03 | 0.37 | Yes | No |
| I904E | −1.15 | 0.08 | −1.73 | 0.09 | −0.77 | 0.30 | No | No |
| I904G | −1.05 | 0.04 | −0.45 | 0.04 | −0.39 | 0.03 | No | No |
| I904H | NA | NA | NA | NA | −0.20 | 0.48 | Yes | No |
| I904L | −0.35 | 0.07 | 0.47 | 0.06 | 0.12 | 0.09 | Yes | No |
| I904K | −1.71 | 0.15 | −0.48 | 0.10 | 0.05 | 0.09 | Yes | No |
| I904M | 0.19 | 0.08 | −0.04 | 0.08 | 0.03 | 0.05 | Yes | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| I904F | −0.71 | 0.13 | 0.38 | 0.11 | 0.15 | 0.20 | Yes | No |
| I904S | 0.20 | 0.04 | −0.09 | 0.04 | 0.07 | 0.03 | Yes | No |
| I904* | −1.37 | 0.12 | −1.64 | 0.13 | NA | NA | Yes | No |
| I904T | 0.33 | 0.07 | −0.20 | 0.07 | −0.13 | 0.08 | Yes | No |
| I904W | −0.01 | 0.06 | −0.07 | 0.06 | −0.35 | 0.24 | No | No |
| I904Y | 0.53 | 0.12 | −0.47 | 0.13 | 0.01 | 0.64 | Yes | No |
| I904V | −0.13 | 0.05 | 0.08 | 0.04 | 0.00 | 0.04 | Yes | No |
| I905A | −0.31 | 0.06 | −0.49 | 0.06 | −0.02 | 0.14 | No | No |
| I905R | −1.93 | 0.08 | −1.23 | 0.06 | −1.47 | 0.09 | No | No |
| I905N | −0.95 | 0.15 | −0.68 | 0.14 | NA | NA | Yes | No |
| I905D | −1.69 | 0.14 | −1.47 | 0.12 | NA | NA | Yes | No |
| I905C | −0.01 | 0.10 | 0.49 | 0.09 | −0.12 | 0.11 | Yes | No |
| I905E | −1.48 | 0.10 | −2.09 | 0.12 | −1.57 | 0.43 | No | No |
| I905G | −1.25 | 0.05 | −0.83 | 0.04 | −0.80 | 0.04 | No | No |
| I905L | −0.65 | 0.07 | −0.31 | 0.06 | −0.12 | 0.07 | No | No |
| I905M | 0.15 | 0.06 | −0.40 | 0.07 | −0.10 | 0.06 | Yes | No |
| I905F | −0.10 | 0.11 | −0.09 | 0.11 | −0.55 | 0.18 | No | No |
| I905S | −1.01 | 0.07 | −1.06 | 0.07 | −0.63 | 0.06 | No | No |
| I905T | −0.17 | 0.09 | −0.86 | 0.09 | −0.52 | 0.12 | No | No |
| I905W | −1.31 | 0.10 | −1.78 | 0.11 | −1.43 | 0.28 | No | No |
| I905V | −0.18 | 0.05 | −0.21 | 0.05 | 0.10 | 0.06 | Yes | No |
| G906A | 0.41 | 0.05 | 0.56 | 0.04 | 0.42 | 0.05 | Yes | Yes |
| G906S | 0.40 | 0.05 | 0.16 | 0.05 | 0.15 | 0.06 | Yes | Yes |
| G906R | −1.82 | 0.06 | −2.39 | 0.07 | −1.63 | 0.08 | No | No |
| G906D | −1.49 | 0.10 | −1.05 | 0.08 | −1.38 | 0.18 | No | No |
| G906C | −1.50 | 0.11 | −1.21 | 0.09 | −1.62 | 0.11 | No | No |
| G906E | −2.26 | 0.12 | −1.63 | 0.09 | −1.49 | 0.11 | No | No |
| G906L | −1.51 | 0.09 | −2.32 | 0.11 | −1.69 | 0.27 | No | No |
| G906P | −1.68 | 0.12 | −1.05 | 0.09 | −1.66 | 0.10 | No | No |
| G906* | NA | NA | NA | NA | −1.21 | 0.40 | Yes | No |
| G906T | −1.69 | 0.11 | −2.68 | 0.15 | NA | NA | Yes | No |
| G906W | −2.22 | 0.11 | −1.14 | 0.07 | −1.71 | 0.08 | No | No |
| G906V | −0.85 | 0.05 | −1.20 | 0.05 | −1.27 | 0.06 | No | No |
| I907A | 0.70 | 0.10 | 0.42 | 0.10 | 0.27 | 0.54 | Yes | Yes |
| I907V | 0.15 | 0.07 | 0.12 | 0.07 | 0.13 | 0.06 | Yes | Yes |
| I907R | −0.92 | 0.08 | −1.15 | 0.08 | −0.89 | 0.09 | No | No |
| I907D | −0.44 | 0.17 | −0.97 | 0.18 | NA | NA | Yes | No |
| I907C | −0.16 | 0.16 | 0.84 | 0.13 | 0.12 | 0.64 | Yes | No |
| I907E | −1.06 | 0.15 | −0.42 | 0.12 | NA | NA | Yes | No |
| I907G | −0.42 | 0.06 | −0.40 | 0.06 | −0.03 | 0.06 | No | No |
| I907L | 0.34 | 0.09 | 0.24 | 0.08 | −0.33 | 0.09 | Yes | No |
| I907M | NA | NA | NA | NA | 0.12 | 0.25 | Yes | No |
| I907F | −0.50 | 0.19 | −0.17 | 0.17 | NA | NA | Yes | No |
| I907S | −0.29 | 0.03 | −0.18 | 0.03 | 0.25 | 0.03 | Yes | No |
| I907T | −0.44 | 0.15 | 0.78 | 0.12 | 0.28 | 0.12 | Yes | No |
| D908A | −2.26 | 0.13 | −1.92 | 0.11 | −1.10 | 0.16 | No | No |
| D908R | NA | NA | NA | NA | −1.53 | 0.09 | Yes | No |
| D908N | −0.27 | 0.12 | −0.30 | 0.12 | −0.70 | 0.14 | No | No |
| D908E | −1.61 | 0.13 | −1.42 | 0.11 | −1.11 | 0.11 | No | No |
| D908G | −2.25 | 0.09 | −2.15 | 0.08 | −1.77 | 0.14 | No | No |
| D908S | −1.92 | 0.16 | −1.78 | 0.14 | NA | NA | Yes | No |
| D908W | −1.93 | 0.15 | −2.11 | 0.15 | NA | NA | Yes | No |
| D908Y | 0.26 | 0.11 | −0.07 | 0.12 | −0.15 | 0.12 | Yes | No |
| D908V | −1.74 | 0.10 | −1.76 | 0.10 | −1.52 | 0.09 | No | No |
| R909A | NA | NA | NA | NA | −1.45 | 0.37 | Yes | No |
| R909Q | −0.25 | 0.18 | −0.94 | 0.20 | NA | NA | Yes | No |
| R909G | −1.30 | 0.05 | −1.49 | 0.05 | −1.38 | 0.06 | No | No |
| R909K | −0.87 | 0.16 | −0.60 | 0.14 | NA | NA | Yes | No |
| R909S | −1.08 | 0.10 | −0.84 | 0.09 | −0.58 | 0.12 | No | No |
| R909T | −1.28 | 0.15 | −0.89 | 0.13 | NA | NA | Yes | No |
| R909W | −0.96 | 0.10 | −1.94 | 0.13 | NA | NA | Yes | No |
| R909V | −1.36 | 0.11 | −2.33 | 0.14 | −1.34 | 0.47 | No | No |
| G910R | −1.03 | 0.08 | −1.62 | 0.09 | −1.75 | 0.16 | No | No |
| G910D | NA | NA | NA | NA | −0.69 | 0.19 | Yes | No |
| G910C | −0.91 | 0.13 | −1.29 | 0.14 | NA | NA | Yes | No |
| G910S | −1.15 | 0.10 | −1.28 | 0.10 | −1.41 | 0.19 | No | No |
| G910W | −1.93 | 0.15 | −1.82 | 0.13 | NA | NA | Yes | No |
| G910V | −1.34 | 0.08 | −1.15 | 0.07 | −0.66 | 0.13 | No | No |
| E911A | −0.79 | 0.12 | −1.56 | 0.14 | −0.93 | 0.10 | No | No |
| E911R | −1.42 | 0.12 | −2.19 | 0.14 | NA | NA | Yes | No |
| E911D | −0.45 | 0.14 | −0.47 | 0.13 | −0.18 | 0.25 | No | No |
| E911G | −0.65 | 0.06 | −0.80 | 0.06 | −0.83 | 0.08 | No | No |
| E911L | NA | NA | NA | NA | −0.50 | 0.15 | Yes | No |
| E911K | −0.39 | 0.13 | −0.14 | 0.12 | −0.57 | 0.15 | No | No |

TABLE 3-continued

Summary of selected variants in different background conditions.[1]

| Mutant | Enrich. Score (1) | Stand. Error (1) | Enrich. Score (2) | Stand. Error (2) | Enrich. Score (3) | Stand. Error (3) | Any positive enrichment? | Consistent positive enrichment? |
|---|---|---|---|---|---|---|---|---|
| E911* | −0.20 | 0.11 | 0.12 | 0.10 | −0.18 | 0.16 | Yes | No |
| E911V | −0.21 | 0.08 | −0.62 | 0.08 | −0.61 | 0.09 | No | No |
| R912A | 0.46 | 0.09 | 0.49 | 0.09 | 0.31 | 0.64 | Yes | Yes |
| R912L | 0.53 | 0.08 | 0.38 | 0.08 | 0.21 | 0.16 | Yes | Yes |
| R912S | 1.04 | 0.11 | 0.30 | 0.11 | 0.31 | 0.54 | Yes | Yes |
| R912V | 0.19 | 0.09 | 0.23 | 0.09 | 0.03 | 0.09 | Yes | Yes |
| R912C | 0.43 | 0.15 | 0.54 | 0.15 | −0.29 | 0.16 | Yes | No |
| R912Q | 0.22 | 0.05 | 0.15 | 0.05 | −0.05 | 0.09 | Yes | No |
| R912E | 0.53 | 0.12 | −0.67 | 0.14 | NA | NA | Yes | No |
| R912G | −0.21 | 0.05 | −1.04 | 0.06 | −0.56 | 0.05 | No | No |
| R912P | 0.53 | 0.09 | 0.79 | 0.09 | −0.40 | 0.14 | Yes | No |
| R912T | −0.54 | 0.17 | −0.07 | 0.15 | 0.52 | 0.65 | Yes | No |
| R912W | −0.09 | 0.07 | −0.14 | 0.07 | −0.43 | 0.10 | No | No |
| N913A | −1.19 | 0.13 | −0.97 | 0.11 | −0.87 | 0.33 | No | No |
| N913R | −2.49 | 0.14 | −0.64 | 0.07 | −1.67 | 0.40 | No | No |
| N913D | −0.62 | 0.13 | −0.44 | 0.12 | −0.75 | 0.10 | No | No |
| N913E | −0.91 | 0.12 | −1.92 | 0.16 | NA | NA | Yes | No |
| N913G | −1.34 | 0.07 | −0.91 | 0.06 | −1.56 | 0.30 | No | No |
| N913H | 0.12 | 0.07 | 0.13 | 0.07 | −0.20 | 0.12 | Yes | No |
| N913I | −0.16 | 0.09 | −0.18 | 0.09 | −0.18 | 0.12 | No | No |
| N913L | −0.39 | 0.11 | −0.72 | 0.11 | NA | NA | Yes | No |
| N913K | −0.37 | 0.05 | −0.29 | 0.04 | −0.27 | 0.08 | No | No |
| N913S | −0.29 | 0.08 | −0.06 | 0.07 | −0.20 | 0.12 | No | No |
| N913T | 0.09 | 0.11 | −0.67 | 0.12 | −0.35 | 0.24 | Yes | No |
| N913Y | −0.47 | 0.18 | −0.44 | 0.17 | NA | NA | Yes | No |
| N913V | −1.32 | 0.12 | −0.89 | 0.10 | −1.09 | 0.18 | No | No |

[1]Key to Header abbreviations: Mutants are defined by single letter amino acid (wild-type) at a given position in the wild-type AsCas12a polypeptide (e.g., amino acid position 500), followed by the variant amino acid change thereafter; "Enrich. Score (1)" refers to Enrichment score of the variant in a Condition 1 background; "Stand. Error (1) refers to the Standard error for experiments conducted for a given variant in a Condition 1 background; "Enrich. Score (2)" refers to Enrichment Score of the variant in a Condition 2 background; "Stand. Error (2) refers to the Standard Error for experiments conducted for a given variant in a Condition 2 background; "Enrich. Score (3)"refers to Enrichment Score of the variant in a Condition 3 background; "Stand. Error (3) refers to the Standard Error for experiments conducted for a given variant in a Condition 3 background; "Any Positive Enrichment?" refers to the occurrence of positive enrichment for a given variant under at least one experimental Condition background; "Consistent positive enrichment?" refers to the occurrence of positive enrichment for a given variant under all tested experimental Condition backgrounds.

One hundred eighty-seven (187) variants (~6% of total) consistently enhanced the survival rate under all conditions (Table 4). These variants, including the four validated individually, can be stacked on the WT- or M537R/F870L-AsCas12a, to boost its DNA cleavage activity at TTTT-PAM.

TABLE 4

Point mutations consistently enriched over the reference proteins under all conditions.[1]

| SEQ ID NO.: | Mutant | Position | Variant score (condition 1) | Variant score (condition 2) | Variant score (condition 3) |
|---|---|---|---|---|---|
| 59 | R499C | 499 | 0.14 ± 0.08 | 0.6 ± 0.07 | 0.06 ± 0.1 |
| 60 | R499L | 499 | 0.08 ± 0.05 | 0.05 ± 0.06 | 0.09 ± 0.15 |
| 61 | R499K | 499 | 0.54 ± 0.06 | 0.23 ± 0.06 | 0.38 ± 0.1 |
| 62 | L500M | 500 | 0.01 ± 0.05 | 0.3 ± 0.05 | 0.28 ± 0.12 |
| 63 | T501L | 501 | 0.18 ± 0.04 | 0.32 ± 0.04 | 0.12 ± 0.07 |
| 64 | T501M | 501 | 0.32 ± 0.07 | 0.35 ± 0.07 | 0.17 ± 0.29 |
| 65 | T501V | 501 | 0.22 ± 0.06 | 0.29 ± 0.06 | 0.13 ± 0.2 |
| 66 | G502R | 502 | 0.14 ± 0.05 | 0.28 ± 0.05 | 0.98 ± 0.07 |
| 67 | G502E | 502 | 0.42 ± 0.08 | 0.17 ± 0.08 | 0.19 ± 0.3 |
| 68 | G502L | 502 | 0.45 ± 0.07 | 0.1 ± 0.07 | 0 ± 0.11 |
| 69 | G502S | 502 | 0.08 ± 0.06 | 0.23 ± 0.06 | 0.16 ± 0.12 |
| 70 | G502W | 502 | 0.14 ± 0.07 | 0.65 ± 0.06 | 0.36 ± 0.14 |
| 71 | G502V | 502 | 0.21 ± 0.05 | 0.21 ± 0.05 | 0.13 ± 0.07 |
| 72 | L505A | 505 | 0.61 ± 0.05 | 0.5 ± 0.05 | 0.47 ± 0.13 |
| 73 | L505R | 505 | 0.4 ± 0.03 | 0.56 ± 0.03 | 0.81 ± 0.05 |
| 74 | L505Q | 505 | 0.3 ± 0.07 | 0.82 ± 0.07 | 0.16 ± 0.11 |
| 75 | L505E | 505 | 0.18 ± 0.06 | 0.03 ± 0.07 | 0.14 ± 0.21 |
| 76 | L505G | 505 | 0.18 ± 0.03 | 0.72 ± 0.03 | 0.4 ± 0.05 |
| 77 | L505H | 505 | 0.33 ± 0.11 | 0.83 ± 0.1 | 0.34 ± 0.32 |
| 78 | L505K | 505 | 0.02 ± 0.1 | 1 ± 0.08 | 1 ± 0.13 |
| 79 | L505S | 505 | 0.13 ± 0.06 | 0.32 ± 0.06 | 0.6 ± 0.07 |
| 80 | E506A | 506 | 0.33 ± 0.03 | 0.47 ± 0.03 | 0.7 ± 0.05 |
| 81 | E506R | 506 | 0.46 ± 0.03 | 0.81 ± 0.03 | 1.2 ± 0.04 |
| 82 | E506N | 506 | 0.24 ± 0.09 | 0.53 ± 0.09 | 0.5 ± 0.29 |
| 83 | E506C | 506 | 0.2 ± 0.06 | 0.29 ± 0.06 | 0.49 ± 0.19 |
| 84 | E506Q | 506 | 0.09 ± 0.07 | 0.74 ± 0.06 | 0.33 ± 0.15 |
| 85 | E506G | 506 | 0.24 ± 0.02 | 0.39 ± 0.02 | 0.53 ± 0.03 |
| 86 | E506H | 506 | 0.35 ± 0.09 | 0.1 ± 0.1 | 0.98 ± 0.31 |
| 87 | E506I | 506 | 0.47 ± 0.09 | 0.45 ± 0.09 | 0.69 ± 0.13 |
| 88 | E506L | 506 | 0.3 ± 0.04 | 0.61 ± 0.04 | 0.56 ± 0.07 |
| 89 | E506K | 506 | 0.18 ± 0.06 | 0.59 ± 0.05 | 1.08 ± 0.08 |
| 90 | E506M | 506 | 0.53 ± 0.06 | 0.28 ± 0.07 | 0.47 ± 0.17 |
| 91 | E506S | 506 | 0.01 ± 0.05 | 0.47 ± 0.04 | 0.5 ± 0.06 |
| 92 | E506T | 506 | 0.39 ± 0.06 | 0.12 ± 0.07 | 0.9 ± 0.23 |
| 93 | E506Y | 506 | 0.16 ± 0.09 | 0.29 ± 0.09 | 0.43 ± 0.25 |
| 94 | E506V | 506 | 0.45 ± 0.03 | 0.51 ± 0.03 | 0.75 ± 0.05 |
| 95 | E508A | 508 | 0.36 ± 0.03 | 0.2 ± 0.03 | 0.18 ± 0.06 |
| 96 | E508R | 508 | 0.54 ± 0.03 | 0.8 ± 0.03 | 0.82 ± 0.06 |
| 97 | E508Q | 508 | 0.25 ± 0.06 | 0.11 ± 0.07 | 0.51 ± 0.13 |
| 98 | E508G | 508 | 0.16 ± 0.02 | 0.17 ± 0.02 | 0.22 ± 0.04 |
| 99 | E508L | 508 | 0.03 ± 0.04 | 0.1 ± 0.04 | 0.26 ± 0.11 |
| 100 | E508K | 508 | 0.2 ± 0.06 | 0.49 ± 0.06 | 0.66 ± 0.08 |
| 101 | E508M | 508 | 0.25 ± 0.07 | 0.57 ± 0.06 | 0.54 ± 0.11 |
| 102 | E508F | 508 | 0.27 ± 0.08 | 0.19 ± 0.08 | 0.39 ± 0.29 |
| 103 | E508S | 508 | 0.31 ± 0.05 | 0.62 ± 0.04 | 0.34 ± 0.06 |
| 104 | E508T | 508 | 0.19 ± 0.06 | 0.73 ± 0.06 | 0.55 ± 0.1 |
| 105 | E508Y | 508 | 0.35 ± 0.09 | 0.19 ± 0.1 | 0.21 ± 0.27 |
| 106 | E508V | 508 | 0.16 ± 0.03 | 0.22 ± 0.03 | 0.34 ± 0.05 |
| 107 | P509R | 509 | 0.23 ± 0.03 | 0.27 ± 0.03 | 1.04 ± 0.05 |

TABLE 4-continued

Point mutations consistently enriched over the reference proteins under all conditions.[1]

| SEQ ID NO.: | Mutant | Position | Variant score (condition 1) | Variant score (condition 2) | Variant score (condition 3) |
|---|---|---|---|---|---|
| 108 | P509K | 509 | 0.01 ± 0.07 | 0.12 ± 0.07 | 1.29 ± 0.13 |
| 109 | P509M | 509 | 0.34 ± 0.07 | 0.34 ± 0.07 | 0.1 ± 0.22 |
| 110 | P509S | 509 | 0.1 ± 0.04 | 0.14 ± 0.04 | 0.14 ± 0.1 |
| 111 | P509W | 509 | 0.04 ± 0.05 | 0.33 ± 0.05 | 0.61 ± 0.18 |
| 112 | P509Y | 509 | 0.18 ± 0.09 | 0.2 ± 0.09 | 0.53 ± 0.3 |
| 113 | S510G | 510 | 0.18 ± 0.03 | 0.49 ± 0.03 | 0.21 ± 0.06 |
| 114 | S510L | 510 | 0.57 ± 0.06 | 0.72 ± 0.06 | 0.74 ± 0.09 |
| 115 | S512R | 512 | 0.07 ± 0.07 | 0.34 ± 0.07 | 0.07 ± 0.19 |
| 116 | F513L | 513 | 0.53 ± 0.04 | 0.63 ± 0.04 | 0.41 ± 0.07 |
| 117 | F513W | 513 | 0.04 ± 0.06 | 0.35 ± 0.06 | 0.28 ± 0.13 |
| 118 | N515A | 515 | 0.6 ± 0.06 | 0.82 ± 0.06 | 0.12 ± 0.11 |
| 119 | N515R | 515 | 0.63 ± 0.06 | 0.82 ± 0.05 | 0.19 ± 0.11 |
| 120 | N515I | 515 | 0.23 ± 0.07 | 0.3 ± 0.07 | 0.16 ± 0.14 |
| 121 | N515L | 515 | 0.33 ± 0.06 | 0.53 ± 0.06 | 0.07 ± 0.2 |
| 122 | N515T | 515 | 0.41 ± 0.08 | 0.14 ± 0.08 | 0.29 ± 0.16 |
| 123 | N515V | 515 | 0.5 ± 0.05 | 0.49 ± 0.05 | 0.45 ± 0.09 |
| 124 | K516R | 516 | 0.01 ± 0.03 | 0.26 ± 0.03 | 0.4 ± 0.06 |
| 125 | R518K | 518 | 0.2 ± 0.09 | 0.72 ± 0.08 | 0.05 ± 0.17 |
| 126 | T522L | 522 | 1.1 ± 0.05 | 0.92 ± 0.05 | 0.28 ± 0.1 |
| 127 | T522M | 522 | 0.92 ± 0.07 | 0.81 ± 0.08 | 0.53 ± 0.21 |
| 128 | T522V | 522 | 0.16 ± 0.05 | 0.28 ± 0.05 | 0.04 ± 0.07 |
| 129 | K523R | 523 | 0.17 ± 0.02 | 0.37 ± 0.02 | 0 ± 0.03 |
| 130 | S527D | 527 | 0.13 ± 0.11 | 0.01 ± 0.11 | 0.34 ± 0.41 |
| 131 | V528D | 528 | 0.01 ± 0.07 | 0.27 ± 0.07 | 0.12 ± 0.12 |
| 132 | V528L | 528 | 0.55 ± 0.03 | 0.59 ± 0.03 | 0.31 ± 0.07 |
| 133 | V528M | 528 | 0.19 ± 0.05 | 0.02 ± 0.05 | 0.13 ± 0.1 |
| 134 | S542N | 542 | 0.24 ± 0.09 | 0.02 ± 0.09 | 0.29 ± 0.07 |
| 135 | S542C | 542 | 0.03 ± 0.17 | 0.15 ± 0.17 | 0.42 ± 0.16 |
| 136 | K550R | 550 | 0.05 ± 0.03 | 0.18 ± 0.03 | 0.17 ± 0.07 |
| 137 | N551D | 551 | 0.14 ± 0.04 | 0.15 ± 0.04 | 0.67 ± 0.07 |
| 138 | A554I | 554 | 0.15 ± 0.09 | 0.71 ± 0.08 | 0.39 ± 0.34 |
| 139 | A554T | 554 | 0.45 ± 0.04 | 0.32 ± 0.05 | 0.93 ± 0.07 |
| 140 | A554V | 554 | 0.57 ± 0.03 | 0.48 ± 0.03 | 0.54 ± 0.04 |
| 141 | I555V | 555 | 0.41 ± 0.03 | 0.13 ± 0.03 | 0.14 ± 0.06 |
| 142 | L556M | 556 | 0.08 ± 0.08 | 0.1 ± 0.08 | 0.11 ± 0.21 |
| 143 | V558M | 558 | 0.24 ± 0.06 | 0.15 ± 0.06 | 0.1 ± 0.12 |
| 144 | K559A | 559 | 0.17 ± 0.04 | 0.08 ± 0.04 | 0.13 ± 0.08 |
| 145 | N560A | 560 | 0.34 ± 0.05 | 0.18 ± 0.05 | 0.18 ± 0.08 |
| 146 | N560D | 560 | 0.16 ± 0.04 | 0.18 ± 0.04 | 0.16 ± 0.08 |
| 147 | N560E | 560 | 0.48 ± 0.06 | 0.28 ± 0.06 | 0.11 ± 0.25 |
| 148 | N560M | 560 | 0.16 ± 0.09 | 0.31 ± 0.09 | 0.18 ± 0.13 |
| 149 | P569D | 569 | 0.6 ± 0.08 | 0.33 ± 0.08 | 1.25 ± 0.11 |
| 150 | Q571A | 571 | 0.64 ± 0.07 | 0.39 ± 0.08 | 1.09 ± 0.23 |
| 151 | Q571P | 571 | 0.17 ± 0.07 | 0.61 ± 0.07 | 0.13 ± 0.14 |
| 152 | Q571S | 571 | 0.25 ± 0.09 | 0.2 ± 0.09 | 0.89 ± 0.23 |
| 153 | Q571T | 571 | 0.22 ± 0.13 | 0.19 ± 0.13 | 0.87 ± 0.41 |
| 154 | K572E | 572 | 0.11 ± 0.04 | 0.25 ± 0.04 | 0.42 ± 0.08 |
| 155 | Y575G | 575 | 0.53 ± 0.04 | 0.21 ± 0.04 | 0.32 ± 0.07 |
| 156 | Y575M | 575 | 0.89 ± 0.11 | 0.27 ± 0.12 | 0.31 ± 0.41 |
| 157 | K576C | 576 | 0.27 ± 0.07 | 0.25 ± 0.07 | 0.1 ± 0.26 |
| 158 | S579T | 579 | 0.17 ± 0.04 | 0.33 ± 0.04 | 0.01 ± 0.06 |
| 159 | S579V | 579 | 0.04 ± 0.03 | 0.02 ± 0.03 | 0.05 ± 0.07 |
| 160 | T583I | 583 | 0.04 ± 0.08 | 0.11 ± 0.07 | 0.07 ± 0.17 |
| 161 | E584H | 584 | 0.09 ± 0.07 | 0.22 ± 0.07 | 0.17 ± 0.14 |
| 162 | E584V | 584 | 0.1 ± 0.03 | 0.06 ± 0.03 | 0.12 ± 0.04 |
| 163 | K585R | 585 | 0.07 ± 0.03 | 0.32 ± 0.03 | 0.06 ± 0.05 |
| 164 | K585F | 585 | 0.51 ± 0.09 | 0.04 ± 0.09 | 0.61 ± 0.36 |
| 165 | D596E | 596 | 0.04 ± 0.04 | 0.24 ± 0.04 | 0.69 ± 0.05 |
| 166 | P599G | 599 | 0.84 ± 0.04 | 0.83 ± 0.04 | 1.01 ± 0.05 |
| 167 | A602C | 602 | 0.64 ± 0.09 | 0.61 ± 0.09 | 0.73 ± 0.28 |
| 168 | L612M | 612 | 0.7 ± 0.07 | 0.7 ± 0.07 | 0.01 ± 0.03 |
| 169 | A614R | 614 | 0.28 ± 0.04 | 0.07 ± 0.05 | 0.16 ± 0.05 |
| 170 | A614I | 614 | 0.52 ± 0.11 | 0.59 ± 0.11 | 0.41 ± 0.22 |
| 171 | T616A | 616 | 0.32 ± 0.03 | 0.24 ± 0.04 | 0.09 ± 0.05 |
| 172 | T616R | 616 | 0.19 ± 0.03 | 0.12 ± 0.03 | 0.62 ± 0.04 |
| 173 | T616Q | 616 | 0.35 ± 0.07 | 0.38 ± 0.07 | 0.78 ± 0.2 |
| 174 | T616G | 616 | 0.22 ± 0.03 | 0.01 ± 0.03 | 0.16 ± 0.06 |
| 175 | T616Y | 616 | 0.54 ± 0.09 | 0.64 ± 0.09 | 0.05 ± 0.38 |
| 176 | A617G | 617 | 0.03 ± 0.03 | 0.05 ± 0.03 | 0.24 ± 0.06 |
| 177 | F619M | 619 | 0.12 ± 0.07 | 0.55 ± 0.07 | 0.22 ± 0.25 |
| 178 | Q620A | 620 | 0.22 ± 0.04 | 0 ± 0.05 | 0.18 ± 0.09 |
| 179 | Q620R | 620 | 0.25 ± 0.03 | 0.18 ± 0.03 | 0.17 ± 0.04 |
| 180 | Q620N | 620 | 0.26 ± 0.14 | 0.28 ± 0.14 | 0.36 ± 0.21 |
| 181 | Q620L | 620 | 0.14 ± 0.04 | 0.45 ± 0.04 | 0.4 ± 0.16 |
| 182 | Q620K | 620 | 0.1 ± 0.07 | 0.24 ± 0.07 | 0.04 ± 0.1 |
| 183 | T621A | 621 | 0.18 ± 0.04 | 0.13 ± 0.04 | 0.17 ± 0.1 |
| 184 | H622G | 622 | 0.05 ± 0.03 | 0.18 ± 0.03 | 0.07 ± 0.06 |
| 185 | H622S | 622 | 0.16 ± 0.06 | 0.59 ± 0.06 | 0.08 ± 0.1 |
| 186 | H622T | 622 | 0.01 ± 0.09 | 0.84 ± 0.08 | 0.31 ± 0.34 |
| 187 | H622V | 622 | 0.18 ± 0.05 | 0.15 ± 0.05 | 0.31 ± 0.12 |
| 188 | T623E | 623 | 0.32 ± 0.05 | 0.23 ± 0.05 | 0.02 ± 0.05 |
| 189 | T623H | 623 | 0.6 ± 0.1 | 0.01 ± 0.11 | 0.58 ± 0.55 |
| 190 | T623L | 623 | 0.33 ± 0.05 | 0.18 ± 0.05 | 0.17 ± 0.16 |
| 191 | T623M | 623 | 0.21 ± 0.07 | 0.28 ± 0.07 | 0.59 ± 0.22 |
| 192 | T623F | 623 | 0.8 ± 0.1 | 0.61 ± 0.1 | 0.47 ± 0.32 |
| 193 | T624P | 624 | 0.92 ± 0.02 | 0.92 ± 0.02 | 0.04 ± 0.03 |
| 194 | L627C | 627 | 0.14 ± 0.13 | 0.84 ± 0.11 | 0.57 ± 0.48 |
| 195 | L628C | 628 | 0.31 ± 0.09 | 0.1 ± 0.1 | 0.29 ± 0.31 |
| 196 | L628W | 628 | 0.25 ± 0.06 | 0.01 ± 0.07 | 0.67 ± 0.15 |
| 197 | N630R | 630 | 0.53 ± 0.05 | 0.06 ± 0.06 | 0.94 ± 0.08 |
| 198 | I633N | 633 | 0.16 ± 0.06 | 0.65 ± 0.06 | 0.15 ± 0.1 |
| 199 | I633M | 633 | 0.17 ± 0.07 | 0.28 ± 0.07 | 0.1 ± 0.19 |
| 200 | I633S | 633 | 0.02 ± 0.04 | 0.35 ± 0.04 | 0.22 ± 0.08 |
| 201 | E634N | 634 | 0.52 ± 0.12 | 0.46 ± 0.12 | 0 ± 0.36 |
| 202 | P635A | 635 | 0.04 ± 0.05 | 0.29 ± 0.05 | 0.59 ± 0.07 |
| 203 | P635D | 635 | 0.14 ± 0.09 | 0.49 ± 0.09 | 0.52 ± 0.14 |
| 204 | P635E | 635 | 0.51 ± 0.06 | 0.49 ± 0.06 | 0.7 ± 0.16 |
| 205 | P635T | 635 | 0.36 ± 0.06 | 0.06 ± 0.06 | 0.01 ± 0.08 |
| 206 | T639G | 639 | 0.52 ± 0.06 | 0.44 ± 0.06 | 0.06 ± 0.23 |
| 207 | D840S | 840 | 0.37 ± 0.08 | 0.33 ± 0.08 | 0.1 ± 0.16 |
| 208 | A842S | 842 | 0.36 ± 0.06 | 0.08 ± 0.06 | 0.04 ± 0.1 |
| 209 | A844E | 844 | 0.38 ± 0.1 | 0.06 ± 0.1 | 0.13 ± 0.21 |
| 210 | T851A | 851 | 0.41 ± 0.06 | 0.14 ± 0.06 | 0.08 ± 0.1 |
| 211 | T851V | 851 | 0.32 ± 0.06 | 0.13 ± 0.06 | 0.54 ± 0.07 |
| 212 | E853V | 853 | 0.14 ± 0.07 | 0.1 ± 0.07 | 0.38 ± 0.09 |
| 213 | R862K | 862 | 0.04 ± 0.14 | 0.54 ± 0.13 | 0.02 ± 0.38 |
| 214 | S866F | 866 | 0 ± 0.13 | 0.06 ± 0.12 | 0.1 ± 0.14 |
| 215 | S866T | 866 | 0.05 ± 0.13 | 0.02 ± 0.13 | 0.4 ± 0.15 |
| 216 | V873A | 873 | 0.16 ± 0.11 | 0.05 ± 0.11 | 0.08 ± 0.16 |
| 217 | N878D | 878 | 0.03 ± 0.06 | 0.02 ± 0.06 | 0.04 ± 0.08 |
| 218 | Q880R | 880 | 0.13 ± 0.05 | 0.02 ± 0.05 | 0.01 ± 0.06 |
| 219 | Q880G | 880 | 0.25 ± 0.04 | 0.19 ± 0.04 | 0.64 ± 0.05 |
| 220 | A882D | 882 | 0.32 ± 0.05 | 0.22 ± 0.05 | 0.1 ± 0.07 |
| 221 | A882S | 882 | 0.11 ± 0.12 | 0.14 ± 0.11 | 0.23 ± 0.22 |
| 222 | N883G | 883 | 0.42 ± 0.08 | 0.37 ± 0.08 | 0.03 ± 0.11 |
| 223 | N883K | 883 | 0.12 ± 0.16 | 0.23 ± 0.16 | 0.16 ± 0.1 |
| 224 | S884V | 884 | 0.05 ± 0.11 | 0.61 ± 0.1 | 0.03 ± 0.14 |
| 225 | S886L | 886 | 0.09 ± 0.08 | 0.12 ± 0.08 | 0.05 ± 0.11 |
| 226 | S886M | 886 | 0.32 ± 0.11 | 0.15 ± 0.11 | 0.4 ± 0.35 |
| 227 | S886W | 886 | 0.23 ± 0.07 | 0.01 ± 0.07 | 0.7 ± 0.19 |
| 228 | Q890C | 890 | 0.03 ± 0.11 | 0.64 ± 0.1 | 0.08 ± 0.54 |
| 229 | Q890H | 890 | 0.39 ± 0.09 | 0.07 ± 0.09 | 0.04 ± 0.11 |
| 230 | Q890W | 890 | 0.03 ± 0.08 | 0.23 ± 0.07 | 0.03 ± 0.08 |
| 231 | A894R | 894 | 0.19 ± 0.06 | 0.06 ± 0.06 | 0.04 ± 0.08 |
| 232 | A894D | 894 | 0.04 ± 0.06 | 0.09 ± 0.06 | 0.21 ± 0.05 |
| 233 | Y895D | 895 | 0.16 ± 0.04 | 0 ± 0.04 | 0.09 ± 0.04 |
| 234 | H899A | 899 | 0.21 ± 0.08 | 0.16 ± 0.07 | 0.01 ± 0.48 |
| 235 | H899N | 899 | 0.15 ± 0.15 | 0.7 ± 0.14 | 0.08 ± 0.18 |
| 236 | E901D | 901 | 0.07 ± 0.1 | 0.05 ± 0.1 | 0.14 ± 0.15 |
| 237 | P903T | 903 | 0.64 ± 0.13 | 0.52 ± 0.12 | 0.39 ± 0.18 |
| 328 | G906A | 906 | 0.41 ± 0.05 | 0.56 ± 0.04 | 0.42 ± 0.05 |
| 239 | G906S | 906 | 0.4 ± 0.05 | 0.16 ± 0.05 | 0.15 ± 0.06 |
| 240 | I907A | 907 | 0.7 ± 0.1 | 0.42 ± 0.1 | 0.27 ± 0.54 |
| 241 | I907V | 907 | 0.15 ± 0.07 | 0.12 ± 0.07 | 0.13 ± 0.06 |
| 242 | R912A | 912 | 0.46 ± 0.09 | 0.49 ± 0.09 | 0.31 ± 0.64 |
| 243 | R912L | 912 | 0.53 ± 0.08 | 0.38 ± 0.08 | 0.21 ± 0.16 |
| 244 | R912S | 912 | 1.04 ± 0.11 | 0.3 ± 0.11 | 0.31 ± 0.54 |
| 245 | R912V | 912 | 0.19 ± 0.09 | 0.23 ± 0.09 | 0.03 ± 0.09 |

[1]The phenotype scores (i.e. natural logarithm of relative enrichment) of each point mutation are provided. The error bar estimates the precision of the measurement, which is dependent on the sequencing count of each variant in the libraries. Only variants with counts greater than 50 in all libraries were included in the analysis.

Table 5 shows the sequences used as primers to generate the AsCas12a saturation mutagenesis library. Standard recombinant methods and techniques were used. The screening library was constructed using the method described in Wrenbeck et al. (2016).

TABLE 5

Primer sequences to generate AsCas12a saturation mutagenesis library.

| SEQ ID NO.: | Name | Sequence (5'-3')[a] |
|---|---|---|
| 246 | 499_NNK_HsCas12a_R499 | gaccccgagttctccgccNNKctgacaggcatcaaactg |
| 247 | 500_NNK_HsCas12a_L500 | ggaccccgagttctccgccagaNNKacaggcatcaaac |
| 248 | 501_NNK_HsCas12a_T501 | cgagttctccgccagactgNNKggcatcaaactggaaatgg |
| 249 | 502_NNK_HsCas12a_G502 | gagttctccgccagactgacaNNKatcaaactggaaatggaaccc |
| 250 | 503_NNK_HsCas12a_I503 | ctccgccagactgacaggcNNKaaactggaaatggaaccca |
| 251 | 504_NNK_HsCas12a_K504 | gccagactgacaggcatcNNKctggaaatggaacccagc |
| 252 | 505_NNK_HsCas12a_L505 | ccagactgacaggcatcaaaNNKgaaatggaacccagcctgtc |
| 253 | 506_NNK_HsCas12a_E506 | gactgacaggcatcaaactgNNKatggaacccagcctgtccttt |
| 254 | 507_NNK_HsCas12a_M507 | ctgacaggcatcaaactggaaNNKgaacccagcctgtccttctac |
| 255 | 508_NNK_HsCas12a_E508 | ctgacaggcatcaaactggaaatgNNKcccagcctgtccttc |
| 256 | 509_NNK_HsCas12a_P509 | gactgacaggcatcaaactggaaatggaaNNKagcctgtccttctac |
| 257 | 510_NNK_HsCas12a_S510 | atcaaactggaaatggaacccNNKctgtccttctacaacaaggcc |
| 258 | 511_NNK_HsCas12a_L511 | aaactggaaatggaacccagcNNKtccttctacaacaaggccaga |
| 259 | 512_NNK_HsCas12a_S512 | ctggaaatggaacccagcctgNNKttctacaacaaggccagaaac |
| 260 | 513_NNK_HsCas12a_F513 | gaaatggaacccagcctgtccNNKtacaacaaggccagaaactac |
| 261 | 514_NNK_HsCas12a_Y514 | ggaacccagcctgtccttcNNKaacaaggccagaaactacg |
| 262 | 515_NNK_HsCas12a_N515 | cccagcctgtccttctacNNKaaggccagaaactacgcc |
| 263 | 516_NNK_HsCas12a_K516 | cagcctgtccttctacaacNNKgccagaaactacgccacca |
| 264 | 517_NNK_HsCas12a_A517 | cagcctgtccttctacaacaagNNKagaaactacgccaccaagaaac |
| 265 | 518_NNK_HsCas12a_R518 | ctgtccttctacaacaaggccNNKaactacgccaccaagaaaccc |
| 266 | 519_NNK_HsCas12a_N519 | tccttctacaacaaggccagaNNKtacgccaccaagaaaccctac |
| 267 | 520_NNK_HsCas12a_Y520 | ttctacaacaaggccagaaacNNKgccaccaagaaaccctacagc |
| 268 | 521_NNK_HsCas12a_A521 | tacaacaaggccagaaactacNNKaccaagaaaccctacagcgtg |
| 269 | 522_NNK_HsCas12a_T522 | caaggccagaaactacgccNNKaagaaaccctacagcgtgg |
| 270 | 523_NNK_HsCas12a_K523 | ggccagaaactacgccaccNNKaaaccctacagcgtggaaa |
| 271 | 524_NNK_HsCas12a_K524 | ccagaaactacgccaccaagNNKccctacagcgtggaaaagtt |
| 272 | 525_NNK_HsCas12a_P525 | ggccagaaactacgccaccaagaaaNNKtacagcgtggaaaagtttaag |
| 273 | 526_NNK_HsCas12a_Y526 | aactacgccaccaagaaacccNNKagcgtggaaaagtttaagctg |
| 274 | 527_NNK_HsCas12a_S527 | ctacgccaccaagaaacctacNNKgtggaaaagtttaagctgaactt |
| 275 | 528_NNK_HsCas12a_V528 | cgccaccaagaaaccctacagcNNKgaaaagtttaagctgaacttcc |
| 276 | 529_NNK_HsCas12a_E529 | caccaagaaaccctacagcgtgNNKaagtttaagctgaacttccaga |
| 277 | 530_NNK_HsCas12a_K530 | caagaaaccctacagcgtggaaNNKtttaagctgaacttccagatgc |
| 278 | 531_NNK_HsCas12a_F531 | aaaccctacagcgtggaaaagNNKaagctgaacttccagatgccc |
| 279 | 532_NNK_HsCas12a_K532 | ccctacagcgtggaaaagtttNNKctgaacttccagatgcccac |
| 280 | 533_NNK_HsCas12a_L533 | tacagcgtggaaaagtttaagNNKaacttccagatgcccaccctg |
| 281 | 534_NNK_HsCas12a_N534 | gcgtggaaaagtttaagctgNNKttccagatgcccaccctggc |
| 282 | 535_NNK_HsCas12a_F535 | cgtggaaaagtttaagctgaacNNKcagatgcccaccctggccag |
| 283 | 536_NNK_HsCas12a_Q536 | ggaaaagtttaagctgaacttcNNKatgcccaccctggccagcg |

TABLE 5-continued

Primer sequences to generate AsCas12a saturation mutagenesis library.

| SEQ ID NO.: | Name | Sequence (5'-3')[a] |
|---|---|---|
| 284 | 537_NNK_HsCas12a_M537 | ttaagctgaacttccagNNKcccaccctggccagcgg |
| 285 | 538_NNK_HsCas12a_P538 | aagctgaacttccagatgNNKaccctggccagcggct |
| 286 | 539_NNK_HsCas12a_T539 | gaacttccagatgcccNNKctggccagcggctggg |
| 287 | 540_NNK_HsCas12a_L540 | ttccagatgcccaccNNKgccagcggctgggac |
| 288 | 541_NNK_HsCas12a_A541 | cagatgcccaccctgNNKagcggctgggacgtg |
| 289 | 542_NNK_HsCas12a_S542 | atgcccaccctggccNNKggctgggacgtgaacaa |
| 290 | 543_NNK_HsCas12a_G543 | gcccaccctggccagcNNKtgggacgtgaacaaag |
| 291 | 544_NNK_HsCas12a_W544 | ccaccctggccagcggcNNKgacgtgaacaaagagaag |
| 292 | 545_NNK_HsCas12a_D545 | ccctggccagcggctggNNKgtgaacaaagagaagaac |
| 293 | 546_NNK_HsCas12a_V546 | ctggccagcggctgggacNNKaacaaagagaagaacaacg |
| 294 | 547_NNK_HsCas12a_N547 | ccagcggctgggacgtgNNKaaagagaagaacaacggc |
| 295 | 548_NNK_HsCas12a_K548 | gcggctgggacgtgaacNNKgagaagaacaacggcgc |
| 296 | 549_NNK_HsCas12a_E549 | cggctgggacgtgaacaaaNNKaagaacaacggcgccatc |
| 297 | 550_NNK_HsCas12a_K550 | ctgggacgtgaacaaagagNNKaacaacggcgccatcctgt |
| 298 | 551_NNK_HsCas12a_N551 | gggacgtgaacaaagagaagNNKaacggcgccatcctgttcg |
| 299 | 552_NNK_HsCas12a_N552 | gacgtgaacaaagagaagaacNNKggcgccatcctgttcgtgaa |
| 300 | 553_NNK_HsCas12a_G553 | cgtgaacaaagagaagaacaacNNKgccatcctgttcgtgaagaacg |
| 301 | 554_NNK_HsCas12a_A554 | gaacaaagagaagaacaacggcNNKatcctgttcgtgaagaacggac |
| 302 | 555_NNK_HsCas12a_I555 | agagaagaacaacggcgccNNKctgttcgtgaagaacggac |
| 303 | 556_NNK_HsCas12a_L556 | gagaagaacaacggcgccatcNNKttcgtgaagaacggactgtac |
| 304 | 557_NNK_HsCas12a_F557 | gaacaacggcgccatcctgNNKgtgaagaacggactgtact |
| 305 | 558_NNK_HsCas12a_V558 | caacggcgccatcctgttcNNKaagaacggactgtactacc |
| 306 | 559_NNK_HsCas12a_K559 | ggcgccatcctgttcgtgNNKaacggactgtactacctg |
| 307 | 560_NNK_HsCas12a_N560 | gccatcctgttcgtgaagNNKggactgtactacctgggc |
| 308 | 561_NNK_HsCas12a_G561 | gccatcctgttcgtgaagaacNNKctgtactacctgggcatcatg |
| 309 | 562_NNK_HsCas12a_L562 | tcctgttcgtgaagaacggaNNKtactacctgggcatcatgcc |
| 310 | 563_NNK_HsCas12a_Y563 | ctgttcgtgaagaacggactgNNKtacctgggcatcatgcctaag |
| 311 | 564_NNK_HsCas12a_Y564 | cgtgaagaacggactgtacNNKctgggcatcatgcctaagc |
| 312 | 565_NNK_HsCas12a_L565 | gtgaagaacggactgtactacNNKggcatcatgcctaagcagaag |
| 313 | 566_NNK_HsCas12a_G566 | aagaacggactgtactacctgNNKatcatgcctaagcagaagggc |
| 314 | 567_NNK_HsCas12a_I567 | ggactgtactacctgggcNNKatgcctaagcagaagggc |
| 315 | 568_NNK_HsCas12a_M568 | gactgtactacctgggcatcNNKcctaagcagaagggcagata |
| 316 | 569_NNK_HsCas12a_P569 | ctgtactacctgggcatcatgNNKaagcagaagggcagatacaag |
| 317 | 570_NNK_HsCas12a_K570 | ctacctgggcatcatgcctNNKcagaagggcagatacaagg |
| 318 | 571_NNK_HsCas12a_Q571 | cctgggcatcatgcctaagNNKaagggcagatacaaggccc |
| 319 | 572_NNK_HsCas12a_K572 | ggcatcatgcctaagcagNNKggcagatacaaggccctg |
| 320 | 573_NNK_HsCas12a_G573 | ggcatcatgcctaagcagaagNNKagatacaaggccctgtccttt |
| 321 | 574_NNK_HsCas12a_R574 | catgcctaagcagaagggcNNKtacaaggccctgtccttg |

TABLE 5-continued

Primer sequences to generate AsCas12a saturation mutagenesis library.

| SEQ ID NO.: | Name | Sequence (5'-3')[a] |
|---|---|---|
| 322 | 575_NNK_HsCas12a_Y575 | gcctaagcagaagggcagaNNKaaggccctgtcctttgagc |
| 323 | 576_NNK_HsCas12a_K576 | aagcagaagggcagatacNNKgccctgtcctttgagccc |
| 324 | 577_NNK_HsCas12a_A577 | gcagaagggcagatacaagNNKctgtcctttgagcccaccg |
| 325 | 578_NNK_HsCas12a_L578 | gaagggcagatacaaggccNNKtcctttgagcccaccgaaa |
| 326 | 579_NNK_HsCas12a_S579 | gggcagatacaaggccctgNNKtttgagcccaccgaaaaga |
| 327 | 580_NNK_HsCas12a_F580 | agatacaaggccctgtccNNKgagcccaccgaaaagacc |
| 328 | 581_NNK_HsCas12a_E581 | ggcagatacaaggccctgtcctttNNKcccaccgaaaagac |
| 329 | 582_NNK_HsCas12a_P582 | caaggccctgtcctttgagNNKaccgaaaagaccagcgag |
| 330 | 584_NNK_HsCas12a_E584 | ctgtcctttgagcccaccNNKaagaccagcgagggcttt |
| 331 | 584_NNK_HsCas12a_T584 | ccctgtcctttgagcccNNKaaaagaccagcgaggg |
| 332 | 585_NNK_HsCas12a_K585 | gtcctttgagcccaccgaaNNKaccagcgagggctttg |
| 333 | 586_NNK_HsCas12a_T586 | tgtcctttgagcccaccgaaaagNNKagcgagggctttgac |
| 334 | 587_NNK_HsCas12a_S587 | tttgagcccaccgaaaagaccNNKgagggctttgacaagatgtac |
| 335 | 588_NNK_HsCas12a_E588 | gagcccaccgaaaagaccagcNNKggctttgacaagatgtactac |
| 336 | 589_NNK_HsCas12a_G589 | cccaccgaaaagaccagcgagNNKtttgacaagatgtactacgat |
| 337 | 590_NNK_HsCas12a_F590 | accgaaaagaccagcgagggcNNKgacaagatgtactacgattact |
| 338 | 591_NNK_HsCas12a_D591 | ccgaaaagaccagcgagggctttNNKaagatgtactacgattacttcc |
| 339 | 592_NNK_HsCas12a_K592 | aagaccagcgagggctttgacNNKatgtactacgattacttcccc |
| 340 | 593_NNK_HsCas12a_M593 | ccagcgagggctttgacaagNNKtactacgattacttccccga |
| 341 | 594_NNK_HsCas12a_Y594 | gcgagggctttgacaagatgNNKtacgattacttccccgacgc |
| 342 | 595_NNK_HsCas12a_Y595 | gggctttgacaagatgtacNNKgattacttccccgacgccg |
| 343 | 596_NNK_HsCas12a_D596 | ggctttgacaagatgtactacNNKtacttccccgacgccgccaa |
| 344 | 597_NNK_HsCas12a_Y597 | agggctttgacaagatgtactacgatNNKttccccgacgccgc |
| 345 | 598_NNK_HsCas12a_F598 | gctttgacaagatgtactacgattacNNKccccgacgccgccaaga |
| 346 | 599_NNK_HsCas12a_P599 | tttgacaagatgtactacgattacttcNNKgacgccgccaagatgatc |
| 347 | 600_NNK_HsCas12a_D600 | gtactacgattacttccccNNKgccgccaagatgatcccca |
| 348 | 601_NNK_HsCas12a_A601 | actacgattacttccccgacNNKgccaagatgatccccaagtg |
| 349 | 602_NNK_HsCas12a_A602 | cgattacttccccgacgccNNKaagatgatccccaagtgca |
| 350 | 603_NNK_HsCas12a_K603 | cttccccgacgccgccNNKatgatccccaagtgca |
| 351 | 604_NNK_HsCas12a_M604 | cccgacgccgccaagNNKatccccaagtgcagc |
| 352 | 605_NNK_HsCas12a_I605 | cgacgccgccaagatgNNKcccaagtgcagcaccc |
| 353 | 606_NNK_HsCas12a_P606 | gacgccgccaagatgatcNNKaagtgcagcacccagctg |
| 354 | 607_NNK_HsCas12a_K607 | ccgccaagatgatccccNNKtgcagcacccagctgaa |
| 355 | 608_NNK_HsCas12a_C608 | gccaagatgatccccaagNNKagcacccagctgaaggcc |
| 356 | 609_NNK_HsCas12a_S609 | aagatgatccccaagtgcNNKacccagctgaaggccgtg |
| 357 | 610_NNK_HsCas12a_T610 | tgatccccaagtgcagcNNKcagctgaaggccgtgac |
| 358 | 611_NNK_HsCas12a_Q611 | ccccaagtgcagcaccNNKctgaaggccgtgaccg |
| 359 | 613_NNK_HsCas12a_K613 | tgcagcacccagctgNNKgccgtgaccgcccac |

TABLE 5-continued

Primer sequences to generate AsCas12a saturation mutagenesis library.

| SEQ ID NO.: | Name | Sequence (5'-3')[a] |
|---|---|---|
| 360 | 613_NNK_HsCas12a_L613 | caagtgcagcacccagNNKaaggccgtgaccgccc |
| 361 | 614_NNK_HsCas12a_A614 | gcagcacccagctgaagNNKgtgaccgcccactttca |
| 362 | 615_NNK_HsCas12a_V615 | gcacccagctgaaggccNNKaccgcccactttcagac |
| 363 | 616_NNK_HsCas12a_T616 | ccagctgaaggccgtgNNKgcccactttcagaccc |
| 364 | 617_NNK_HsCas12a_A617 | cagctgaaggccgtgaccNNKcactttcagacccacacc |
| 365 | 618_NNK_HsCas12a_H618 | tgaaggccgtgaccgccNNKtttcagacccacaccac |
| 366 | 619_NNK_HsCas12a_F619 | gccgtgaccgcccacNNKcagacccacaccacc |
| 367 | 620_NNK_HsCas12a_Q620 | aaggccgtgaccgcccactttNNKacccacaccacc |
| 368 | 621_NNK_HsCas12a_T621 | gaccgcccactttcagNNKcacaccaccccatcc |
| 369 | 622_NNK_HsCas12a_H622 | cgcccactttcagaccNNKaccaccccatcctgc |
| 370 | 623_NNK_HsCas12a_T623 | cccactttcagacccacNNKaccccatcctgctgag |
| 371 | 624_NNK_HsCas12a_T624 | cactttcagacccacaccNNKcccatcctgctgagcaac |
| 372 | 625_NNK_HsCas12a_P625 | cactttcagacccacaccaccNNKatcctgctgagcaacaacttc |
| 373 | 626_NNK_HsCas12a_I626 | cagacccacaccaccccNNKctgctgagcaacaacttc |
| 374 | 627_NNK_HsCas12a_L627 | gacccacaccaccccatcNNKctgagcaacaacttcatcg |
| 375 | 628_NNK_HsCas12a_L628 | ccacaccaccccatcctgNNKagcaacaacttcatcgagc |
| 376 | 629_NNK_HsCas12a_S629 | accaccccatcctgctgNNKaacaacttcatcgagccc |
| 377 | 630_NNK_HsCas12a_N630 | cccccatcctgctgagcNNKaacttcatcgagcccct |
| 378 | 631_NNK_HsCas12a_N631 | cccatcctgctgagcaacNNKttcatcgagcccctggaa |
| 379 | 632_NNK_HsCas12a_F632 | ccatcctgctgagcaacaacNNKatcgagcccctggaaatcac |
| 380 | 633_NNK_HsCas12a_I633 | cctgctgagcaacaacttcNNKgagcccctggaaatcacca |
| 381 | 634_NNK_HsCas12a_E634 | cctgctgagcaacaacttcatcNNKcccctggaaatcaccaaagag |
| 382 | 635_NNK_HsCas12a_P635 | gctgagcaacaacttcatcgagNNKctggaaatcaccaaagagatct |
| 383 | 636_NNK_HsCas12a_L636 | gagcaacaacttcatcgagcccNNKgaaatcaccaaagagatctacg |
| 384 | 637_NNK_HsCas12a_E637 | aacaacttcatcgagcccctgNNKatcaccaaagagatctacgac |
| 385 | 638_NNK_HsCas12a_I638 | aacaacttcatcgagcccctggaaNNKaccaaagagatctacgacc |
| 386 | 639_NNK_HsCas12a_T639 | ttcatcgagcccctggaaatcNNKaaagagatctacgacctgaac |
| 387 | 640_NNK_HsCas12a_K640 | cgagcccctggaaatcaccNNKgagatctacgacctgaaca |
| 388 | 840_NNK_HsCas12a_D840 | ctgagccacgacctgtccNNKgaagctagagcactgctg |
| 389 | 841_NNK_HsCas12a_E841 | ccacgacctgtccgacNNKgctagagcactgctgc |
| 390 | 842_NNK_HsCas12a_A842 | ccacgacctgtccgacgaaNNKagagcactgctgccc |
| 391 | 843_NNK_HsCas12a_R843 | gacctgtccgacgaagctNNKgcactgctgcccaacg |
| 392 | 844_NNK_HsCas12a_A844 | ctgtccgacgaagctagaNNKctgctgcccaacgtgatc |
| 393 | 845_NNK_HsCas12a_L845 | gtccgacgaagctagagcaNNKctgcccaacgtgatcacaa |
| 394 | 846_NNK_HsCas12a_L846 | ccgacgaagctagagcactgNNKcccaacgtgatcacaaaaga |
| 395 | 847_NNK_HsCas12a_P847 | gacgaagctagagcactgctgNNKaacgtgatcacaaaagaggtg |
| 396 | 848_NNK_HsCas12a_N848 | aagctagagcactgctgcccNNKgtgatcacaaaagaggtgtc |
| 397 | 849_NNK_HsCas12a_V849 | ctagagcactgctgcccaacNNKatcacaaaagaggtgtccca |

TABLE 5-continued

Primer sequences to generate AsCas12a saturation mutagenesis library.

| SEQ ID NO.: | Name | Sequence (5'-3')[a] |
|---|---|---|
| 398 | 850_NNK_HsCas12a_I850 | gcactgctgcccaacgtgNNKacaaaagaggtgtcccac |
| 399 | 851_NNK_HsCas12a_T851 | ctgctgcccaacgtgatcNNKaaagaggtgtcccacgag |
| 400 | 852_NNK_HsCas12a_K852 | ctgcccaacgtgatcacaNNKgaggtgtcccacgagatc |
| 401 | 853_NNK_HsCas12a_E853 | cactgctgcccaacgtgatcacaaaaNNKgtgtcccacgagat |
| 402 | 854_NNK_HsCas12a_V854 | gcccaacgtgatcacaaaagagNNKtcccacgagatcatcaaggac |
| 403 | 855_NNK_HsCas12a_S855 | aacgtgatcacaaaagaggtgNNKcacgagatcatcaaggaccgg |
| 404 | 856_NNK_HsCas12a_H856 | tgatcacaaaagaggtgtccNNKgagatcatcaaggaccggcg |
| 405 | 857_NNK_HsCas12a_E857 | cacaaaagaggtgtcccacNNKatcatcaaggaccggcggt |
| 406 | 858_NNK_HsCas12a_I858 | caaaagaggtgtcccacgagNNKatcaaggaccggcggtttac |
| 407 | 859_NNK_HsCas12a_I859 | gaggtgtcccacgagatcNNKaaggaccggcggtttacc |
| 408 | 860_NNK_HsCas12a_K860 | gtgtcccacgagatcatcNNKgaccggcggtttacctc |
| 409 | 861_NNK_HsCas12a_D861 | gtgtcccacgagatcatcaagNNKcggcggtttacctcc |
| 410 | 862_NNK_HsCas12a_R862 | tcccacgagatcatcaaggacNNKcggtttacctccgataagttc |
| 411 | 863_NNK_HsCas12a_R863 | cacgagatcatcaaggaccggNNKtttacctccgataagttcttc |
| 412 | 864_NNK_HsCas12a_F864 | gagatcatcaaggaccggcggNNKacctccgataagttcttcttc |
| 413 | 865_NNK_HsCas12a_T865 | cgagatcatcaaggaccggcggtttNNKtccgataagttcttcttc |
| 414 | 866_NNK_HsCas12a_S866 | atcaaggaccggcggtttaccNNKgataagttcttcttccacgtg |
| 415 | 867_NNK_HsCas12a_D867 | ggaccggcggtttacctccNNKaagttcttcttccacgtgc |
| 416 | 868_NNK_HsCas12a_K868 | ccggcggtttacctccgatNNKttcttcttccacgtgccc |
| 417 | 869_NNK_HsCas12a_F869 | ggcggtttacctccgataagNNKttcttccacgtgcccatcac |
| 418 | 870_NNK_HsCas12a_F870 | ggtttacctccgataagttcNNKttccacgtgcccatcaccct |
| 419 | 871_NNK_HsCas12a_F871 | tttacctccgataagttcttcNNKcacgtgcccatcaccctgaac |
| 420 | 872_NNK_HsCas12a_H872 | acctccgataagttcttcttcNNKgtgcccatcaccctgaactac |
| 421 | 873_NNK_HsCas12a_V873 | tccgataagttcttcttccacNNKcccatcaccctgaactaccag |
| 422 | 874_NNK_HsCas12a_P874 | gataagttcttcttccacgtgNNKatcaccctgaactaccaggcc |
| 423 | 875_NNK_HsCas12a_I875 | ttcttcttccacgtgcccNNKaccctgaactaccaggcc |
| 424 | 876_NNK_HsCas12a_T876 | tcttccacgtgcccatcNNKctgaactaccaggccgc |
| 425 | 877_NNK_HsCas12a_L877 | ccacgtgcccatcaccNNKaactaccaggccgcca |
| 426 | 878_NNK_HsCas12a_N878 | cgtgcccatcaccctgNNKtaccaggccgccaaca |
| 427 | 879_NNK_HsCas12a_Y879 | gcccatcaccctgaacNNKcaggccgccaacagcc |
| 428 | 880_NNK_HsCas12a_Q880 | ccatcaccctgaactacNNKgccgccaacagccca |
| 429 | 881_NNK_HsCas12a_A881 | atcaccctgaactaccagNNKgccaacagccccagcaag |
| 430 | 882_NNK_HsCas12a_A882 | accctgaactaccaggccNNKaacagccccagcaagttc |
| 431 | 883_NNK_HsCas12a_N883 | ctgaactaccaggccgccNNKagccccagcaagttcaac |
| 432 | 884_NNK_HsCas12a_S884 | aactaccaggccgccaacNNKcccagcaagttcaaccag |
| 433 | 885_NNK_HsCas12a_P885 | ctaccaggccgccaacagcNNKagcaagttcaaccagagag |
| 434 | 886_NNK_HsCas12a_S886 | caggccgccaacagccccNNKaagttcaaccagagagtg |
| 435 | 887_NNK_HsCas12a_K887 | gccgccaacagccccagcNNKttcaaccagagagtgaac |

TABLE 5-continued

Primer sequences to generate AsCas12a saturation mutagenesis library.

| SEQ ID NO.: | Name | Sequence (5'-3')[a] |
|---|---|---|
| 436 | 888_NNK_HsCas12a_F888 | gccaacagccccagcaagNNKaaccagagagtgaacgcc |
| 437 | 889_NNK_HsCas12a_N889 | caacagccccagcaagttcNNKcagagagtgaacgcctacc |
| 438 | 890_NNK_HsCas12a_Q890 | cagccccagcaagttcaacNNKagagtgaacgcctacctga |
| 439 | 891_NNK_HsCas12a_R891 | ccccagcaagttcaaccagNNKgtgaacgcctacctgaaag |
| 440 | 892_NNK_HsCas12a_V892 | cccagcaagttcaaccagagaNNKaacgcctacctgaaagagcac |
| 441 | 893_NNK_HsCas12a_N893 | gcaagttcaaccagagagtgNNKgcctacctgaaagagcaccc |
| 442 | 894_NNK_HsCas12a_A894 | aagttcaaccagagagtgaacNNKtacctgaaagagcaccccgag |
| 443 | 895_NNK_HsCas12a_Y895 | aaccagagagtgaacgccNNKctgaaagagcaccccgag |
| 444 | 896_NNK_HsCas12a_L896 | ccagagagtgaacgcctacNNKaaagagcaccccgagacac |
| 445 | 897_NNK_HsCas12a_K897 | gagtgaacgcctacctgNNKgagcaccccgagacacc |
| 446 | 898_NNK_HsCas12a_E898 | agagagtgaacgcctacctgaaaNNKcaccccgagacacc |
| 447 | 899_NNK_HsCas12a_H899 | gaacgcctacctgaaagagNNKcccgagacacccatcattg |
| 448 | 900_NNK_HsCas12a_P900 | cgcctacctgaaagagcacNNKgagacacccatcattggca |
| 449 | 901_NNK_HsCas12a_E901 | ctacctgaaagagcaccccNNKacacccatcattggcatcg |
| 450 | 902_NNK_HsCas12a_T902 | ctgaaagagcaccccgagNNKcccatcattggcatcgac |
| 451 | 903_NNK_HsCas12a_P903 | tgaaagagcaccccgagacaNNKatcattggcatcgacagagg |
| 452 | 904_NNK_HsCas12a_I904 | agcaccccgagacacccNNKattggcatcgacagagg |
| 453 | 905_NNK_HsCas12a_I905 | ccccgagacacccatcNNKggcatcgacagaggcg |
| 454 | 906_NNK_HsCas12a_G906 | gagcaccccgagacacccatcattNNKatcgacagaggcg |
| 455 | 907_NNK_HsCas12a_I907 | gagacacccatcattggcNNKgacagaggcgagcggaac |
| 456 | 908_NNK_HsCas12a_D908 | acacccatcattggcatcNNKagaggcgagcggaacctg |
| 457 | 909_NNK_HsCas12a_R909 | cccatcattggcatcgacNNKggcgagcggaacctgatc |
| 458 | 910_NNK_HsCas12a_G910 | cccatcattggcatcgacagaNNKgagcggaacctgatctacatc |
| 459 | 911_NNK_HsCas12a_E911 | tcattggcatcgacagaggcNNKcggaacctgatctacatcac |
| 460 | 912_NNK_HsCas12a_R912 | tggcatcgacagaggcgagNNKaacctgatctacatcaccg |
| 461 | 913_NNK_HsCas12a_N913 | atcgacagaggcgagcggNNKctgatctacatcaccgtg |

[a] For "NNK", N refers to A, C, T or G; K refers to G or T.

With respect to Table 4, the reference (i.e., wild-type) polypeptide sequence is SEQ ID NO.: 462 upon which these mutants are based by comparison. Polynucleotides codon-optimized for expression in *E. coli* and human cells that encode SEQ ID NO.:462 are SEQ ID NOs.: 463 and 464, respectively. The same mutations were introduced as well into M537R/F870L-AsCas12a background. The corresponding reference polypeptide sequence for the M537R/F870L-Cas12a is SEQ ID NO.: 465 (the altered amino acids are underlined). Polynucleotides codon-optimized for expression in *E. coli* and human cells that encode SEQ ID NO.:465 are SEQ ID NOs.: 466 and 467, respectively (the altered codons are underlined).

```
                                          SEQ ID NO.: 462
MTQFEGFTNLYQVSKTLRFELIPQGKTLKHIQEQGFIEEDKARNDHYKEL
KPIIDRIYKTYADQCLQLVQLDWENLSAAIDSYRKEKTEETRNALIEEQA
TYRNAIHDYFIGRTDNLTDAINKRHAEIYKGLFKAELFNGKVLKQLGTVT
TTEHENALLRSFDKFTTYFSGFYENRKNVFSAEDISTAIPHRIVQDNFPK
FKENCHIFTRLITAVPSLREHFENVKKAIGIFVSTSIEEVFSFPFYNQLL
TQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAE
ALFNELNSIDLTHIFISHKKLETISSALCDHWDTLRNALYERRISELTGK
ITKSAKEKVQRSLKHEDINLQEIISAAGKELSEAFKQKTSEILSHAHAAL
DQPLPTTLKKQEEKEILKSQLDSLLGLYHLLDWFAVDESNEVDPEFSARL
TGIKLEMEPSLSFYNKARNYATKKPYSVEKFKLNFQMPTLASGWDVNKEK
NNGAILFVKNGLYYLGIMPKQKGRYKALSFEPTEKTSEGFDKMYYDYFPD
AAKMIPKCSTQLKAVTAHFQTHTTPILLSNNFIEPLEITKEIYDLNNPEK
EPKKFQTAYAKKTGDQKGYREALCKWIDFTRDFLSKYTKTTSIDLSSLRP
SSQYKDLGEYYAELNPLLYHISFQRIAEKEIMDAVETGKLYLFQIYNKDF
AKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVI
TKEVSHEIIKDRRFTSDKFFFHVPITLNYQAANSPSKFNQRVNAYLKEHP
ETPIIGIDRGERNLIYITVIDSTGKILEQRSLNTIQQFDYQKKLDNREKE
RVAARQAWSVVGTIKDLKQGYLSQVIHEIVDLMIHYQAVVVLENLNFGFK
SKRTGIAEKAVYQQFEKMLIDKLNCLVLKDYPAEKVGGVLNPYQLTDQFT
SFAKMGTQSGFLFYVPAPYTSKIDPLTGFVDPFVWKTIKNHESRKHFLEG
FDFLHYDVKTGDFILHFKMNRNLSFQRGLPGFMPAWDIVFEKNETQFDAK
GTPFIAGKRIVPVIENHRFTGRYRDLYPANELIALLEEKGIVFRDGSNIL
PKLLENDDSHAIDTMVALIRSVLQMRNSNAATGEDYINSPVRDLNGVCFD
SRFQNPEWPMDADANGAYHIALKGQLLLNHLKESKDLKLQNGISNQDWLA
YIQELRN

SEQ ID NO.: 463
atgACCCAGTTTGAAGGTTTCACCAATCTGTATCAGGTTAGCAAAACCCT
GCGTTTTGAACTGATTCCGCAGGGTAAAACCCTGAAACATATTCAAGAAC
AGGGCTTCATCGAAGAGGATAAAGCACGTAACGATCACTACAAAGAACTG
AAACCGATTATCGACCGCATCTATAAAACCTATGCAGATCAGTGTCTGCA
GCTGGTTCAGCTGGATTGGGAAAATCTGAGCGCAGCAATTGATAGTTATC
GCAAAGAAAAAACCGAAGAAACCCGTAATGCACTGATTGAAGAACAGGCA
ACCTATCGTAATGCCATCCATGATTATTTCATTGGTCGTACCGATAATCT
GACCGATGCAATTAACAAACGTCACGCCGAAATCTATAAAGGCCTGTTTA
AAGCCGAACTGTTTAATGGCAAAGTTCTGAAACAGCTGGGCACCGTTACC
ACCACCGAACATGAAAATGCACTGCTGCGTAGCTTTGATAAATTCACCAC
CTATTTCAGCGGCTTTTATGAGAATCGCAAAAACGTGTTTAGCGCAGAAG
ATATTAGCACCGCAATTCCGCATCGTATTGTGCAGGATAATTTCCCGAAA
TTCAAAGAGAACTGCCACATTTTTACCCGTCTGATTACCGCAGTTCCGAG
CCTGCGTGAACATTTTGAAAACGTTAAAAAAGCCATCGGCATCTTTGTTA
GCACCAGCATTGAAGAAGTTTTTAGCTTCCCGTTTTACAATCAGCTGCTG
ACCCAGACCCAGATTGATCTGTATAACCAACTGCTGGGTGGTATTAGCCG
TGAAGCAGGCACCGAAAAAATCAAAGGTCTGAATGAAGTGCTGAATCTGG
CCATTCAGAAAAATGATGAAACCGCACATATTATTGCAAGCCTGCCGCAT
CGTTTTATTCCGCTGTTCAAACAAATTCTGAGCGATCGTAATACCCTGAG
CTTTATTCTGGAAGAATTCAAATCCGATGAAGAGGTGATTCAGAGCTTTT
GCAAATACAAAACGCTGCTGCGCAATGAAAATGTTCTGGAAACTGCCGAA
GCACTGTTTAACGAACTGAATAGCATTGATCTGACCCACATCTTTATCAG
CCACAAAAACTGGAAACCATTTCAAGCGCACTGTGTGATCATTGGGATA
CCCTGCGTAATGCCCTGTATGAACGTCGTATTAGCGAACTGACCGGTAAA
ATTACCAAAAGCGCGAAAGAAAAAGTTCAGCGCAGTCTGAAACATGAGGA
TATTAATCTGCAAGAGATTATTAGCGCAGCCGGTAAAGAACTGTCAGAAG
CATTTAAACAGAAAACCAGCGAAATTCTGTCACATGCACATGCAGCACTG
GATCAGCCGCTGCCGACCACCCTGAAAAAACAAGAAGAAAAAGAAATCCT
GAAAAGCCAGCTGGATAGCCTGCTGGGTCTGTATCATCTGCTGGACTGGT
TTGCAGTTGATGAAAGCAATGAAGTTGATCCGGAATTTAGCGCACGTCTG
ACCGGCATTAAACTGGAAATGGAACCGAGCCTGAGCTTTTATAACAAAGC
CCGTAATTATGCCACCAAAAAACCGTATAGCGTCGAAAAATTCAAACTGA
ACTTTCAGATGCCGACCCTGGCAAGCGGTTGGGATGTTAATAAAGAAAAA
AACAACGGTGCCATCCTGTTCGTGAAAAATGGCCTGTATTATCTGGGTAT
TATGCCGAAACAGAAAGGTCGTTATAAAGCGCTGAGCTTTGAACCGACGG
AAAAAACCAGTGAAGGTTTTGATAAAATGTACTACGACTATTTTCCGGAT
GCAGCCAAAATGATTCCGAAATGTAGCACCCAGCTGAAAGCAGTTACCGC
ACATTTTCAGACCCATACCACCCCGATTCTGCTGAGCAATAACTTTATTG
AACCGCTGGAAATCACCAAAGAGATCTACGATCTGAATAACCCGGAAAAA
GAGCCGAAAAAATTCCAGACCGCATATGCAAAAAAAACCGGTGATCAGAA
AGGTTATCGTGAAGCGCTGTGTAAATGGATTGATTTCACCCGTGATTTTC
TGAGCAAATACACCAAAACCACCAGTATCGATCTGAGCAGCCTGCGTCCG
AGCAGCCAGTATAAAGATCTGGGCGAATATTATGCAGAACTGAATCCGCT
GCTGTATCATATTAGCTTTCAGCGTATTGCCGAGAAAGAAATCATGGACG
```

-continued

CAGTTGAAACCGGTAAACTGTACCTGTTCCAGATCTACAATAAAGATTTT

GCCAAAGGCCATCATGGCAAACCGAATCTGCATACCCTGTATTGGACCGG

TCTGTTTAGCCCTGAAAATCTGGCAAAAACCTCGATTAAACTGAATGGTC

AGGCGGAACTGTTTTATCGTCCGAAAAGCCGTATGAAACGTATGGCACAT

CGTCTGGGTGAAAAAATGCTGAACAAAAAACTGAAAGACCAGAAAACCCC

GATCCCGGATACACTGTATCAAGAACTGTATGATTATGTGAACCATCGTC

TGAGCCATGATCTGAGTGATGAAGCACGTGCCCTGCTGCCGAATGTTATT

ACCAAAGAAGTTAGCCACGAGATCATTAAAGATCGTCGTTTTACCAGCGA

CAAATTCTTTTTTCATGTGCCGATTACCCTGAATTATCAGGCAGCAAATA

GCCCGAGCAAATTTAACCAGCGTGTTAATGCATATCTGAAAGAACATCCA

GAAACGCCGATTATTGGTATTGATCGTGGTGAACGTAACCTGATTTATAT

CACCGTTATTGATAGCACCGGCAAAATCCTGGAACAGCGTAGCCTGAATA

CCATTCAGCAGTTTGATTACCAGAAAAAACTGGATAATCGCGAGAAAGAA

CGTGTTGCAGCACGTCAGGCATGGTCAGTTGTTGGTACAATTAAAGACCT

GAAACAGGGTTATCTGAGCCAGGTTATTCATGAAATTGTGGATCTGATGA

TTCACTATCAGGCCGTTGTTGTGCTGGAAAACCTGAATTTTGGCTTTAAA

AGCAAACGTACCGGCATTGCAGAAAAAGCAGTTTATCAGCAGTTCGAGAA

AATGCTGATTGACAAACTGAATTGCCTGGTGCTGAAAGATTATCCGGCTG

AAAAAGTTGGTGGTGTTCTGAATCCGTATCAGCTGACCGATCAGTTTACC

AGCTTTGCAAAAATGGGCACCCAGAGCGGATTTCTGTTTTATGTTCCGGC

ACCGTATACGAGCAAAATTGATCCGCTGACCGGTTTTGTTGATCCGTTTG

TTTGGAAAACCATCAAAACCATGAAAGCCGCAAACATTTTCTGGAAGGT

TTCGATTTTCTGCATTACGACGTTAAAACGGGTGATTTCATCCTGCACTT

TAAAATGAATCGCAATCTGAGTTTTCAGCGTGGCCTGCCTGGTTTTATGC

CTGCATGGGATATTGTGTTTGAGAAAAACGAAACACAGTTCGATGCAAAA

GGCACCCCGTTTATTGCAGGTAAACGTATTGTTCCGGTGATTGAAAATCA

TCGTTTCACCGGTCGTTATCGCGATCTGTATCCGGCAAATGAACTGATCG

CACTGCTGGAAGAGAAAGGTATTGTTTTTCGTGATGGCTCAAACATTCTG

CCGAAACTGCTGGAAAATGATGATAGCCATGCAATTGATACCATGGTTGC

ACTGATTCGTAGCGTTCTGCAGATGCGTAATAGCAATGCAGCAACCGGTG

AAGATTACATTAATAGTCCGGTTCGTGATCTGAATGGTGTTTGTTTTGAT

AGCCGTTTTCAGAATCCGGAATGGCCGATGGATGCAGATGCAAATGGTGC

ATATCATATTGCACTGAAAGGACAGCTGCTGCTGAACCACCTGAAAGAAA

GCAAAGATCTGAAACTGCAAAACGGCATTAGCAATCAGGATTGGCTGGCA

TATATCCAAGAACTGCGTAAC

SEQ ID NO.: 464 atgACCCAGTTTGAAGGTTTCACCAATCTGTATCAGGTTAGCAAAACCCT

GCGTTTTGAACTGATTCCGCAGGGTAAAACCCTGAAACATATTCAAGAAC

AGGGCTTCATCGAAGAGGATAAAGCACGTAACGATCACTACAAAGAACTG

AAACCGATTATCGACCGCATCTATAAAACCTATGCAGATCAGTGTCTGCA

GCTGGTTCAGCTGGATTGGGAAAATCTGAGCGCAGCAATTGATAGTTATC

-continued

GCAAAGAAAAAACCGAAGAAACCCGTAATGCACTGATTGAAGAACAGGCA

ACCTATCGTAATGCCATCCATGATTATTTCATTGGTCGTACCGATAATCT

GACCGATGCAATTAACAAACGTCACGCCGAAATCTATAAAGGCCTGTTTA

AAGCCGAACTGTTTAATGGCAAAGTTCTGAAACAGCTGGGCACCGTTACC

ACCACCGAACATGAAAATGCACTGCTGCGTAGCTTTGATAAATTCACCAC

CTATTTCAGCGGCTTTTATGAGAATCGCAAAAACGTGTTTAGCGCAGAAG

ATATTAGCACCGCAATTCCGCATCGTATTGTGCAGGATAATTTCCCGAAA

TTCAAAGAACTGCCACATTTTTACCCGTCTGATTACCGCAGTTCCGAG

CCTGCGTGAACATTTTGAAAACGTTAAAAAAGCCATCGGCATCTTTGTTA

GCACCAGCATTGAAGAAGTTTTTAGCTTCCCGTTTTACAATCAGCTGCTG

ACCCAGACCCAGATTGATCTGTATAACCAACTGCTGGGTGGTATTAGCCG

TGAAGCAGGCACCGAAAAAAATCAAAGGTCTGAATGAAGTGCTGAATCTGG

CCATTCAGAAAAATGATGAAACCGCACATATTATTGCAAGCCTGCCGCAT

CGTTTTATTCCGCTGTTCAAACAAATTCTGAGCGATCGTAATACCCTGAG

CTTTATTCTGGAAGAATTCAAATCCGATGAAGAGGTGATTCAGAGCTTTT

GCAAATACAAAACGCTGCTGCGCAATGAAAATGTTCTGGAAACTGCCGAA

GCACTGTTTAACGAACTGAATAGCATTGATCTGACCCACATCTTTATCAG

CCACAAAAAACTGGAAACCATTTCAAGCGCACTGTGTGATCATTGGGATA

CCCTGCGTAATGCCCTGTATGAACGTCGTATTAGCGAACTGACCGGTAAA

ATTACCAAAAGCGCGAAAGAAAAAGTTCAGCGCAGTCTGAAACATGAGGA

TATTAATCTGCAAGAGATTATTAGCGCAGCCGGTAAAGAACTGTCAGAAG

CATTTAAACAGAAAACCAGCGAAATTCTGTCACATGCACATGCAGCACTG

GATCAGCCGCTGCCGACCACCCTGAAAAAACAAGAAGAAAAAGAAATCCT

GAAAAGCCAGCTGGATAGCCTGCTGGGTCTGTATCATCTGCTGGACTGGT

TTGCAGTTGATGAAAGCAATGAAGTTGATCCGGAATTTAGCGCACGTCTG

ACCGGCATTAAACTGGAAATGGAACCGAGCCTGAGCTTTTATAACAAAGC

CCGTAATTATGCCACCAAAAAACCGTATAGCGTCGAAAAATTCAAACTGA

ACTTTCAGATGCCGACCCTGGCAAGCGGTTGGGATGTTAATAAAGAAAAA

AACAACGGTGCCATCCTGTTCGTGAAAAATGGCCTGTATTATCTGGGTAT

TATGCCGAAACAGAAAGGTCGTTATAAAGCGCTGAGCTTTGAACCGACGG

AAAAAAACCAGTGAAGGTTTTGATAAAATGTACTACGACTATTTTCCGGAT

GCAGCCAAAATGATTCCGAAATGTAGCACCCAGCTGAAAGCAGTTACCGC

ACATTTTCAGACCCATACCACCCCGATTCTGCTGAGCAATAACTTTATTG

AACCGCTGGAAATCACCAAAGAGATCTACGATCTGAATAACCCGGAAAAA

GAGCCGAAAAAATTCCAGACCGCATATGCAAAAAAACCGGTGATCAGAA

AGGTTATCGTGAAGCGCTGTGTAAATGGATTGATTTCACCCGTGATTTTC

TGAGCAAATACACCAAAACCACCAGTATCGATCTGAGCAGCCTGCGTCCG

AGCAGCCAGTATAAAGATCTGGGCGAATATTATGCAGAACTGAATCCGCT

GCTGTATCATATTAGCTTTCAGCGTATTGCCGAGAAAGAAATCATGGACG

CAGTTGAAACCGGTAAACTGTACCTGTTCCAGATCTACAATAAAGATTTT

GCCAAAGGCCATCATGGCAAACCGAATCTGCATACCCTGTATTGGACCGG

```
TCTGTTTAGCCCTGAAAATCTGGCAAAAACCTCGATTAAACTGAATGGTC
AGGCGGAACTGTTTTATCGTCCGAAAAGCCGTATGAAACGTATGGCACAT
CGTCTGGGTGAAAAAATGCTGAACAAAAAACTGAAAGACCAGAAAACCCC
GATCCCGGATACACTGTATCAAGAACTGTATGATTATGTGAACCATCGTC
TGAGCCATGATCTGAGTGATGAAGCACGTGCCCTGCTGCCGAATGTTATT
ACCAAAGAAGTTAGCCACGAGATCATTAAAGATCGTCGTTTTACCAGCGA
CAAATTCTTTTTTCATGTGCCGATTACCCTGAATTATCAGGCAGCAAATA
GCCCGAGCAAATTTAACCAGCGTGTTAATGCATATCTGAAAGAACATCCA
GAAACGCCGATTATTGGTATTGATCGTGGTGAACGTAACCTGATTTATAT
CACCGTTATTGATAGCACCGGCAAAATCCTGGAACAGCGTAGCCTGAATA
CCATTCAGCAGTTTGATTACCAGAAAAAACTGGATAATCGCGAGAAAGAA
CGTGTTGCAGCACGTCAGGCATGGTCAGTTGTTGGTACAATTAAAGACCT
GAAACAGGGTTATCTGAGCCAGGTTATTCATGAAATTGTGGATCTGATGA
TTCACTATCAGGCCGTTGTTGTGCTGGAAAACCTGAATTTTGGCTTTAAA
AGCAAACGTACCGGCATTGCAGAAAAAGCAGTTTATCAGCAGTTCGAGAA
AATGCTGATTGACAAACTGAATTGCCTGGTGCTGAAAGATTATCCGGCTG
AAAAAGTTGGTGGTGTTCTGAATCCGTATCAGCTGACCGATCAGTTTACC
AGCTTTGCAAAAATGGGCACCCAGAGCGGATTTCTGTTTTATGTTCCGGC
ACCGTATACGAGCAAAATTGATCCGCTGACCGGTTTTGTTGATCCGTTTG
TTTGGAAAACCATCAAAAACCATGAAAGCCGCAAACATTTTCTGGAAGGT
TTCGATTTTCTGCATTACGACGTTAAAACGGGTGATTTCATCCTGCACTT
TAAAATGAATCGCAATCTGAGTTTTCAGCGTGGCCTGCCTGGTTTTATGC
CTGCATGGGATATTGTGTTTGAGAAAAACGAAACACAGTTCGATGCAAAA
GGCACCCCGTTTATTGCAGGTAAACGTATTGTTCCGGTGATTGAAAATCA
TCGTTTCACCGGTCGTTATCGCGATCTGTATCCGGCAAATGAACTGATCG
CACTGCTGGAAGAGAAAGGTATTGTTTTTCGTGATGGCTCAAACATTCTG
CCGAAACTGCTGGAAAATGATGATAGCCATGCAATTGATACCATGGTTGC
ACTGATTCGTAGCGTTCTGCAGATGCGTAATAGCAATGCAGCAACCGGTG
AAGATTACATTAATAGTCCGGTTCGTGATCTGAATGGTGTTTGTTTTGAT
AGCCGTTTTCAGAATCCGGAATGGCCGATGGATGCAGATGCAAATGGTGC
ATATCATATTGCACTGAAAGGACAGCTGCTGCTGAACCACCTGAAAGAAA
GCAAAGATCTGAAACTGCAAAACGGCATTAGCAATCAGGATTGGCTGGCA
TATATCCAAGAACTGCGTAAC
```

SEQ ID NO.: 465
MTQFEGFTNLYQVSKTLRFELIPQGKTLKHIQEQGFIEEDKARNDHYKEL
KPIIDRIYKTYADQCLQLVQLDWENLSAAIDSYRKEKTEETRNALIEEQA
TYRNAIHDYFIGRTDNLTDAINKRHAEIYKGLFKAELFNGKVLKQLGTVT
TTEHENALLRSFDKFTTYFSGFYENRKNVFSAEDISTAIPHRIVQDNFPK
FKENCHIFTRLITAVPSLREHFENVKKAIGIFVSTSIEEVFSFPFYNQLL
TQTQIDLYNQLLGGISREAGTEKIKGLNEVLNLAIQKNDETAHIIASLPH
RFIPLFKQILSDRNTLSFILEEFKSDEEVIQSFCKYKTLLRNENVLETAE

ALFNELNSIDLTHIFISHKKLETISSALCDHWDTLRNALYERRISELTGK
ITKSAKEKVQRSLKHEDINLQEIISAAGKELSEAFKQKTSEILSHAHAAL
DQPLPTTLKKQEEKEILKSQLDSLLGLYHLLDWFAVDESNEVDPEFSARL
TGIKLEMEPSLSFYNKARNYATKKPYSVEKFKLNFQRPTLASGWDVNKEK
NNGAILFVKNGLYYLGIMPKQKGRYKALSFEPTEKTSEGFDKMYYDYFPD
AAKMIPKCSTQLKAVTAHFQTHTTPILLSNNFIEPLEITKEIYDLNNPEK
EPKKFQTAYAKKTGDQKGYREALCKWIDFTRDFLSKYTKTTSIDLSSLRP
SSQYKDLGEYYAELNPLLYHISFQRIAEKEIMDAVETGKLYLFQIYNKDF
AKGHHGKPNLHTLYWTGLFSPENLAKTSIKLNGQAELFYRPKSRMKRMAH
RLGEKMLNKKLKDQKTPIPDTLYQELYDYVNHRLSHDLSDEARALLPNVI
TKEVSHEIIKDRRFTSDKFLFHVPITLNYQAANSPSKFNQRVNAYLKEHP
ETPIIGIDRGERNLIYITVIDSTGKILEQRSLNTIQQFDYQKKLDNREKE
RVAARQAWSVVGTIKDLKQGYLSQVIHEIVDLMIHYQAVVVLENLNFGFK
SKRTGIAEKAVYQQFEKMLIDKLNCLVLKDYPAEKVGGVLNPYQLTDQFT
SFAKMGTQSGFLFYVPAPYTSKIDPLTGFVDPFVWKTIKNHESRKHFLEG
FDFLHYDVKTGDFILHFKMNRNLSFQRGLPGFMPAWDIVFEKNETQFDAK
GTPFIAGKRIVPVIENHRFTGRYRDLYPANELIALLEEKGIVFRDGSNIL
PKLLENDDSHAIDTMVALIRSVLQMRNSNAATGEDYINSPVRDLNGVCFD
SRFQNPEWPMDADANGAYHIALKGQLLLNHLKESKDLKLQNGISNQDWLA
YIQELRN

SEQ ID NO.: 466
atgACCCAGTTTGAAGGTTTCACCAATCTGTATCAGGTTAGCAAAACCCT
GCGTTTTGAACTGATTCCGCAGGGTAAAACCCTGAAACATATTCAAGAAC
AGGGCTTCATCGAAGAGGATAAAGCACGTAACGATCACTACAAAGAACTG
AAACCGATTATCGACCGCATCTATAAAACCTATGCAGATCAGTGTCTGCA
GCTGGTTCAGCTGGATTGGGAAAATCTGAGCGCAGCAATTGATAGTTATC
GCAAAGAAAAAACCGAAGAAACCCGTAATGCACTGATTGAAGAACAGGCA
ACCTATCGTAATGCCATCCATGATTATTTCATTGGTCGTACCGATAATCT
GACCGATGCAATTAACAAACGTCACGCCGAAATCTATAAAGGCCTGTTTA
AAGCCGAACTGTTTAATGGCAAAGTTCTGAAACAGCTGGGCACCGTTACC
ACCACCGAACATGAAAATGCACTGCTGCGTAGCTTTGATAAATTCACCAC
CTATTTCAGCGGCTTTTATGAGAATCGCAAAAACGTGTTTAGCGCAGAAG
ATATTAGCACCGCAATTCCGCATCGTATTGTGCAGGATAATTTCCCGAAA
TTCAAAGAGAACTGCCACATTTTTACCCGTCTGATTACCGCAGTTCCGAG
CCTGCGTGAACATTTTGAAAACGTTAAAAAAGCCATCGGCATCTTTGTTA
GCACCAGCATTGAAGAGTTTTTAGCTTCCCGTTTTACAATCAGCTGCTG
ACCCAGACCCAGATTGATCTGTATAACCAACTGCTGGGTGGTATTAGCCG
TGAAGCAGGCACCGAAAAAATCAAAGGTCTGAATGAAGTGCTGAATCTGG
CCATTCAGAAAAATGATGAAACCGCACATATTATTGCAAGCCTGCCGCAT
CGTTTTATTCCGCTGTTCAAACAAATTCTGAGCGATCGTAATACCCTGAG
CTTTATTCTGGAAGAATTCAAATCCGATGAAGAGGTGATTCAGAGCTTTT
```

-continued

GCAAATACAAAACGCTGCTGCGCAATGAAAATGTTCTGGAAACTGCCGAA

GCACTGTTTAACGAACTGAATAGCATTGATCTGACCCACATCTTTATCAG

CCACAAAAAACTGGAAACCATTTCAAGCGCACTGTGTGATCATTGGGATA

CCCTGCGTAATGCCCTGTATGAACGTCGTATTAGCGAACTGACCGGTAAA

ATTACCAAAAGCGCGAAAGAAAAAGTTCAGCGCAGTCTGAAACATGAGGA

TATTAATCTGCAAGAGATTATTAGCGCAGCCGGTAAAGAACTGTCAGAAG

CATTTAAACAGAAAACCAGCGAAATTCTGTCACATGCACATGCAGCACTG

GATCAGCCGCTGCCGACCACCCTGAAAAAACAAGAAGAAAAAGAAATCCT

GAAAAGCCAGCTGGATAGCCTGCTGGGTCTGTATCATCTGCTGGACTGGT

TTGCAGTTGATGAAAGCAATGAAGTTGATCCGGAATTTAGCGCACGTCTG

ACCGGCATTAAACTGGAAATGGAACCGAGCCTGAGCTTTTATAACAAAGC

CCGTAATTATGCCACCAAAAAACCGTATAGCGTCGAAAAATTCAAACTGA

ACTTTCAGCGTCCGACCCTGGCAAGCGGTTGGGATGTTAATAAAGAAAAA

AACAACGGTGCCATCCTGTTCGTGAAAAATGGCCTGTATTATCTGGGTAT

TATGCCGAAACAGAAAGGTCGTTATAAAGCGCTGAGCTTTGAACCGACGG

AAAAAACCAGTGAAGGTTTTGATAAAATGTACTACGACTATTTTCCGGAT

GCAGCCAAAATGATTCCGAAATGTAGCACCCAGCTGAAAGCAGTTACCGC

ACATTTTCAGACCCATACCACCCCGATTCTGCTGAGCAATAACTTTATTG

AACCGCTGGAAATCACCAAAGAGATCTACGATCTGAATAACCCGGAAAAA

GAGCCGAAAAAATTCCAGACCGCATATGCAAAAAAAACCGGTGATCAGAA

AGGTTATCGTGAAGCGCTGTGTAAATGGATTGATTTCACCCGTGATTTTC

TGAGCAAATACACCAAAACCACCAGTATCGATCTGAGCAGCCTGCGTCCG

AGCAGCCAGTATAAAGATCTGGGCGAATATTATGCAGAACTGAATCCGCT

GCTGTATCATATTAGCTTTCAGCGTATTGCCGAGAAAGAAATCATGGACG

CAGTTGAAACCGGTAAACTGTACCTGTTCCAGATCTACAATAAAGATTTT

GCCAAAGGCCATCATGGCAAACCGAATCTGCATACCCTGTATTGGACCGG

TCTGTTTAGCCCTGAAAATCTGGCAAAAACCTCGATTAAACTGAATGGTC

AGGCGGAACTGTTTTATCGTCCGAAAAGCCGTATGAAACGTATGGCACAT

CGTCTGGGTGAAAAAATGCTGAACAAAAAACTGAAAGACCAGAAAACCCC

GATCCCGGATACACTGTATCAAGAACTGTATGATTATGTGAACCATCGTC

TGAGCCATGATCTGAGTGATGAAGCACGTGCCCTGCTGCCGAATGTTATT

ACCAAAGAAGTTAGCCACGAGATCATTAAAGATCGTCGTTTTACCAGCGA

CAAATTC<u>CTG</u>TTTCATGTGCCGATTACCCTGAATTATCAGGCAGCAAATA

GCCCGAGCAAATTTAACCAGCGTGTTAATGCATATCTGAAAGAACATCCA

GAAACGCCGATTATTGGTATTGATCGTGGTGAACGTAACCTGATTTATAT

CACCGTTATTGATAGCACCGGCAAAATCCTGGAACAGCGTAGCCTGAATA

CCATTCAGCAGTTTGATTACCAGAAAAAACTGGATAATCGCGAGAAAGAA

CGTGTTGCAGCACGTCAGGCATGGTCAGTTGTTGGTACAATTAAAGACCT

GAAACAGGGTTATCTGAGCCAGGTTATTCATGAAATTGTGGATCTGATGA

TTCACTATCAGGCCGTTGTTGTGCTGGAAAACCTGAATTTTGGCTTTAAA

AGCAAACGTACCGGCATTGCAGAAAAAGCAGTTTATCAGCAGTTCGAGAA

AATGCTGATTGACAAACTGAATTGCCTGGTGCTGAAAGATTATCCGGCTG

AAAAAGTTGGTGGTGTTCTGAATCCGTATCAGCTGACCGATCAGTTTACC

AGCTTTGCAAAAATGGGCACCCAGAGCGGATTTCTGTTTTATGTTCCGGC

ACCGTATACGAGCAAAATTGATCCGCTGACCGGTTTTGTTGATCCGTTTG

TTTGGAAAACCATCAAAAACCATGAAAGCCGCAAACATTTTCTGGAAGGT

TTCGATTTTCTGCATTACGACGTTAAAACGGGTGATTTCATCCTGCACTT

TAAAATGAATCGCAATCTGAGTTTTTCAGCGTGGCCTGCCTGGTTTTATGC

CTGCATGGGATATTGTGTTTGAGAAAAACGAAACACAGTTCGATGCAAAA

GGCACCCCGTTTATTGCAGGTAAACGTATTGTTCCGGTGATTGAAAATCA

TCGTTTCACCGGTCGTTATCGCGATCTGTATCCGGCAAATGAACTGATCG

CACTGCTGGAAGAGAAAGGTATTGTTTTTCGTGATGGCTCAAACATTCTG

CCGAAACTGCTGGAAAATGATGATAGCCATGCAATTGATACCATGGTTGC

ACTGATTCGTAGCGTTCTGCAGATGCGTAATAGCAATGCAGCAACCGGTG

AAGATTACATTAATAGTCCGGTTCGTGATCTGAATGGTGTTTGTTTTGAT

AGCCGTTTTCAGAATCCGGAATGGCCGATGGATGCAGATGCAAATGGTGC

ATATCATATTGCACTGAAAGGACAGCTGCTGCTGAACCACCTGAAAGAAA

GCAAAGATCTGAAACTGCAAAACGGCATTAGCAATCAGGATTGGCTGGCA

TATATCCAAGAACTGCGTAAC

SEQ ID NO.: 467 atgACCCAGTTTGAAGGTTTCACCAATCTGTATCAGGTTAGCAAAACCCT

GCGTTTTGAACTGATTCCGCAGGGTAAAACCCTGAAACATATTCAAGAAC

AGGGCTTCATCGAAGAGGATAAAGCACGTAACGATCACTACAAAGAACTG

AAACCGATTATCGACCGCATCTATAAAACCTATGCAGATCAGTGTCTGCA

GCTGGTTCAGCTGGATTGGGAAAATCTGAGCGCAGCAATTGATAGTTATC

GCAAAGAAAAACCGAAGAAACCCGTAATGCACTGATTGAAGAACAGGCA

ACCTATCGTAATGCCATCCATGATTATTTCATTGGTCGTACCGATAATCT

GACCGATGCAATTAACAAACGTCACGCCGAAATCTATAAAGGCCTGTTTA

AAGCCGAACTGTTTAATGGCAAAGTTCTGAAACAGCTGGGCACCGTTACC

ACCACCGAACATGAAAATGCACTGCTGCGTAGCTTTGATAAATTCACCAC

CTATTTCAGCGGCTTTTATGAGAATCGCAAAAACGTGTTTAGCGCAGAAG

ATATTAGCACCGCAATTCCGCATCGTATTGTGCAGGATAATTTCCCGAAA

TTCAAAGAGAACTGCCACATTTTTACCCGTCTGATTACCGCAGTTCCGAG

CCTGCGTGAACATTTTGAAAACGTTAAAAAGCCATCGGCATCTTTGTTA

GCACCAGCATTGAAGAGTTTTTAGCTTCCCGTTTTACAATCAGCTGCTG

ACCCAGACCCAGATTGATCTGTATAACCAACTGCTGGGTGGTATTAGCCG

TGAAGCAGGCACCGAAAAAATCAAAGGTCTGAATGAAGTGCTGAATCTGG

CCATTCAGAAAAATGATGAAACCGCACATATTATTGCAAGCCTGCCGCAT

CGTTTTATTCCGCTGTTCAAACAAATTCTGAGCGATCGTAATACCCTGAG

CTTTATTCTGGAAGAATTCAAATCCGATGAAGAGGTGATTCAGAGCTTTT

GCAAATACAAAACGCTGCTGCGCAATGAAAATGTTCTGGAAACTGCCGAA

```
GCACTGTTTAACGAACTGAATAGCATTGATCTGACCCACATCTTTATCAG

CCACAAAAAACTGGAAACCATTTCAAGCGCACTGTGTGATCATTGGATA

CCCTGCGTAATGCCCTGTATGAACGTCGTATTAGCGAACTGACCGGTAAA

ATTACCAAAAGCGCGAAAGAAAAAGTTCAGCGCAGTCTGAAACATGAGGA

TATTAATCTGCAAGAGATTATTAGCGCAGCCGGTAAAGAACTGTCAGAAG

CATTTAAACAGAAAACCAGCGAAATTCTGTCACATGCACATGCAGCACTG

GATCAGCCGCTGCCGACCACCCTGAAAAAACAAGAAGAAAAAGAAATCCT

GAAAAGCCAGCTGGATAGCCTGCTGGGTCTGTATCATCTGCTGGACTGGT

TTGCAGTTGATGAAAGCAATGAAGTTGATCCGGAATTTAGCGCACGTCTG

ACCGGCATTAAACTGGAAATGGAACCGAGCCTGAGCTTTTATAACAAAGC

CCGTAATTATGCCACCAAAAAACCGTATAGCGTCGAAAAATTCAAACTGA

ACTTTCAGCGTCCGACCCTGGCAAGCGGTTGGGATGTTAATAAAGAAAAA

AACAACGGTGCCATCCTGTTCGTGAAAAATGGCCTGTATTATCTGGGTAT

TATGCCGAAACAGAAAGGTCGTTATAAAGCGCTGAGCTTTGAACCGACGG

AAAAAACCAGTGAAGGTTTTGATAAAATGTACTACGACTATTTTCCGGAT

GCAGCCAAAATGATTCCGAAATGTAGCACCCAGCTGAAAGCAGTTACCGC

ACATTTTCAGACCCATACCACCCCGATTCTGCTGAGCAATAACTTTATTG

AACCGCTGGAAATCACCAAAGAGATCTACGATCTGAATAACCCGGAAAAA

GAGCCGAAAAATTCCAGACCGCATATGCAAAAAAACCGGTGATCAGAA

AGGTTATCGTGAAGCGCTGTGTAAATGGATTGATTTCACCCGTGATTTTC

TGAGCAAATACACCAAAACCACCAGTATCGATCTGAGCAGCCTGCGTCCG

AGCAGCCAGTATAAAGATCTGGGCGAATATTATGCAGAACTGAATCCGCT

GCTGTATCATATTAGCTTTCAGCGTATTGCCGAGAAAGAAATCATGGACG

CAGTTGAAACCGGTAAACTGTACCTGTTCCAGATCTACAATAAAGATTTT

GCCAAAGGCCATCATGGCAAACCGAATCTGCATACCCTGTATTGGACCGG

TCTGTTTAGCCCTGAAAATCTGGCAAAAACCTCGATTAAACTGAATGGTC

AGGCGGAACTGTTTTATCGTCCGAAAAGCCGTATGAAACGTATGGCACAT

CGTCTGGGTGAAAAAATGCTGAACAAAAAACTGAAAGACCAGAAAACCCC

GATCCCGGATACACTGTATCAAGAACTGTATGATTATGTGAACCATCGTC

TGAGCCATGATCTGAGTGATGAAGCACGTGCCCTGCTGCCGAATGTTATT
```

```
ACCAAAGAAGTTAGCCACGAGATCATTAAAGATCGTCGTTTTACCAGCGA

CAAATTCCTGTTTCATGTGCCGATTACCCTGAATTATCAGGCAGCAAATA

GCCCGAGCAAATTTAACCAGCGTGTTAATGCATATCTGAAAGAACATCCA

GAAACGCCGATTATTGGTATTGATCGTGGTGAACGTAACCTGATTTATAT

CACCGTTATTGATAGCACCGGCAAAATCCTGGAACAGCGTAGCCTGAATA

CCATTCAGCAGTTTGATTACCAGAAAAAACTGGATAATCGCGAGAAAGAA

CGTGTTGCAGCACGTCAGGCATGGTCAGTTGTTGGTACAATTAAAGACCT

GAAACAGGGTTATCTGAGCCAGGTTATTCATGAAATTGTGGATCTGATGA

TTCACTATCAGGCCGTTGTTGTGCTGGAAAACCTGAATTTTGGCTTTAAA

AGCAAACGTACCGGCATTGCAGAAAAAGCAGTTTATCAGCAGTTCGAGAA

AATGCTGATTGACAAACTGAATTGCCTGGTGCTGAAAGATTATCCGGCTG

AAAAAGTTGGTGGTGTTCTGAATCCGTATCAGCTGACCGATCAGTTTACC

AGCTTTGCAAAAATGGGCACCCAGAGCGGATTTCTGTTTTATGTTCCGGC

ACCGTATACGAGCAAAATTGATCCGCTGACCGGTTTTGTTGATCCGTTTG

TTTGGAAAACCATCAAAAACCATGAAAGCCGCAAACATTTTCTGGAAGGT

TTCGATTTTCTGCATTACGACGTTAAAACGGGTGATTTCATCCTGCACTT

TAAAATGAATCGCAATCTGAGTTTTCAGCGTGGCCTGCCTGGTTTTATGC

CTGCATGGGATATTGTGTTTGAGAAAAACGAAACACAGTTCGATGCAAAA

GGCACCCCGTTTATTGCAGGTAAACGTATTGTTCCGGTGATTGAAAATCA

TCGTTTCACCGGTCGTTATCGCGATCTGTATCCGGCAAATGAACTGATCG

CACTGCTGGAAGAGAAAGGTATTGTTTTTCGTGATGGCTCAAACATTCTG

CCGAAACTGCTGGAAAATGATGATAGCCATGCAATTGATACCATGGTTGC

ACTGATTCGTAGCGTTCTGCAGATGCGTAATAGCAATGCAGCAACCGGTG

AAGATTACATTAATAGTCCGGTTCGTGATCTGAATGGTGTTTGTTTTGAT

AGCCGTTTTCAGAATCCGGAATGGCCGATGGATGCAGATGCAAATGGTGC

ATATCATATTGCACTGAAAGGACAGCTGCTGCTGAACCACCTGAAAGAAA

GCAAAGATCTGAAACTGCAAAACGGCATTAGCAATCAGGATTGGCTGGCA

TATATCCAAGAACTGCGTAAC
```

Additional polynucleotides and polypeptides relevant to this Example include Cas12a variants having single amino acid substitution at M537R and F870L, as shown below. The underlined codons or amino acids correspond to the changes relative to the corresponding WT Cas12a sequences.

SEQ ID NO.: 468

```
E. coli optimized DNA M537R
atgACCCAGTTTGAAGGTTTCACCAATCTGTATCAGGTTAGCAAAACCCTGCGTTTTGAACTG

ATTCCGCAGGGTAAAACCCTGAAACATATTCAAGAACAGGGCTTCATCGAAGAGGATAAAGCACGTAACGAT

CACTACAAAGAACTGAAACCGATTATCGACCGCATCTATAAAACCTATGCAGATCAGTGTCTGCAGCTGGTTC

AGCTGGATTGGGAAAATCTGAGCGCAGCAATTGATAGTTATCGCAAAGAAAAAACCGAAGAAACCCGTAATG

CACTGATTGAAGAACAGGCAACCTATCGTAATGCCATCCATGATTATTTCATTGGTCGTACCGATAATCTGACC

GATGCAATTAACAAACGTCACGCCGAAATCTATAAAGGCCTGTTTAAAGCCGAACTGTTTAATGGCAAAGTTC

TGAAACAGCTGGGCACCGTTACCACCACCGAACATGAAAATGCACTGCTGCGTAGCTTTGATAAATTCACCAC

CTATTTCAGCGGCTTTTATGAGAATCGCAAAAACGTGTTTAGCGCAGAAGATATTAGCACCGCAATTCCGCAT
```

-continued

```
CGTATTGTGCAGGATAATTTCCCGAAATTCAAAGAGAACTGCCACATTTTTACCCGTCTGATTACCGCAGTTCC

GAGCCTGCGTGAACATTTTGAAAACGTTAAAAAAGCCATCGGCATCTTTGTTAGCACCAGCATTGAAGAAGTT

TTTAGCTTCCCGTTTTACAATCAGCTGCTGACCCAGACCCAGATTGATCTGTATAACCAACTGCTGGGTGGTAT

TAGCCGTGAAGCAGGCACCGAAAAAATCAAAGGTCTGAATGAAGTGCTGAATCTGGCCATTCAGAAAAATGA

TGAAACCGCACATATTATTGCAAGCCTGCCGCATCGTTTTATTCCGCTGTTCAAACAAATTCTGAGCGATCGTA

ATACCCTGAGCTTTATTCTGGAAGAATTCAAATCCGATGAAGAGGTGATTCAGAGCTTTTGCAAATACAAAAC

GCTGCTGCGCAATGAAAATGTTCTGGAAACTGCCGAAGCACTGTTTAACGAACTGAATAGCATTGATCTGACC

CACATCTTTATCAGCCACAAAAAACTGGAAACCATTTCAAGCGCACTGTGTGATCATTGGGATACCCTGCGTA

ATGCCCTGTATGAACGTCGTATTAGCGAACTGACCGGTAAAATTACCAAAAGCGCGAAAGAAAAAGTTCAGC

GCAGTCTGAAACATGAGGATATTAATCTGCAAGAGATTATTAGCGCAGCCGGTAAAGAACTGTCAGAAGCAT

TTAAACAGAAAACCAGCGAAATTCTGTCACATGCACATGCAGCACTGGATCAGCCGCTGCCGACCACCCTGAA

AAAACAAGAAGAAAAGAAATCCTGAAAAGCCAGCTGGATAGCCTGCTGGGTCTGTATCATCTGCTGGACTG

GTTTGCAGTTGATGAAAGCAATGAAGTTGATCCGGAATTTAGCGCACGTCTGACCGGCATTAAACTGGAAAT

GGAACCGAGCCTGAGCTTTTATAACAAAGCCCGTAATTATGCCACCAAAAAACCGTATAGCGTCGAAAAATTC

AAACTGAACTTTCAGCGTCCGACCCTGGCAAGCGGTTGGGATGTTAATAAAGAAAAAAACAACGGTGCCATC

CTGTTCGTGAAAAATGGCCTGTATTATCTGGGTATTATGCCGAAACAGAAAGGTCGTTATAAAGCGCTGAGCT

TTGAACCGACGGAAAAAACCAGTGAAGGTTTTGATAAAATGTACTACGACTATTTTCCGGATGCAGCCAAAAT

GATTCCGAAATGTAGCACCCAGCTGAAAGCAGTTACCGCACATTTTCAGACCCATACCACCCCGATTCTGCTGA

GCAATAACTTTATTGAACCGCTGGAAATCACCAAAGAGATCTACGATCTGAATAACCCGGAAAAAGAGCCGA

AAAAATTCCAGACCGCATATGCAAAAAAAACCGGTGATCAGAAAGGTTATCGTGAAGCGCTGTGTAAATGGA

TTGATTTCACCCGTGATTTTCTGAGCAAATACACCAAAACCACCAGTATCGATCTGAGCAGCCTGCGTCCGAGC

AGCCAGTATAAAGATCTGGGCGAATATTATGCAGAACTGAATCCGCTGCTGTATCATATTAGCTTTCAGCGTA

TTGCCGAGAAAGAAATCATGGACGCAGTTGAAACCGGTAAACTGTACCTGTTCCAGATCTACAATAAAGATTT

TGCCAAAGGCCATCATGGCAAACCGAATCTGCATACCCTGTATTGGACCGGTCTGTTTAGCCCTGAAAATCTG

GCAAAAACCTCGATTAAACTGAATGGTCAGGCGGAACTGTTTTATCGTCCGAAAAGCCGTATGAAACGTATG

GCACATCGTCTGGGTGAAAAAATGCTGAACAAAAAACTGAAAGACCAGAAAACCCCGATCCCGGATACACTG

TATCAAGAACTGTATGATTATGTGAACCATCGTCTGAGCCATGATCTGAGTGATGAAGCACGTGCCCTGCTGC

CGAATGTTATTACCAAAGAAGTTAGCCACGAGATCATTAAAGATCGTCGTTTTACCAGCGACAAATTCTTTTTT

CATGTGCCGATTACCCTGAATTATCAGGCAGCAAATAGCCCGAGCAAATTTAACCAGCGTGTTAATGCATATC

TGAAAGAACATCCAGAAACGCCGATTATTGGTATTGATCGTGGTGAACGTAACCTGATTTATATCACCGTTATT

GATAGCACCGGCAAAATCCTGGAACAGCGTAGCCTGAATACCATTCAGCAGTTTGATTACCAGAAAAACTG

GATAATCGCGAGAAAGAACGTGTTGCAGCACGTCAGGCATGGTCAGTTGTTGGTACAATTAAAGACCTGAAA

CAGGGTTATCTGAGCCAGGTTATTCATGAAATTGTGGATCTGATGATTCACTATCAGGCCGTTGTTGTGCTGG

AAAACCTGAATTTTGGCTTTAAAAGCAAACGTACCGGCATTGCAGAAAAAGCAGTTTATCAGCAGTTCGAGAA

AATGCTGATTGACAAACTGAATTGCCTGGTGCTGAAAGATTATCCGGCTGAAAAAGTTGGTGGTGTTCTGAAT

CCGTATCAGCTGACCGATCAGTTTACCAGCTTTGCAAAAATGGGCACCCAGAGCGGATTTCTGTTTTATGTTCC

GGCACCGTATACGAGCAAAATTGATCCGCTGACCGGTTTTGTTGATCCGTTTGTTTGGAAAACCATCAAAAAC

CATGAAAGCCGCAAACATTTTCTGGAAGGTTTCGATTTTCTGCATTACGACGTTAAAACGGGTGATTTCATCCT

GCACTTTAAAATGAATCGCAATCTGAGTTTTCAGCGTGGCCTGCCTGGTTTTATGCCTGCATGGGATATTGTGT

TTGAGAAAAACGAAACACAGTTCGATGCAAAAGGCACCCCGTTTATTGCAGGTAAACGTATTGTTCCGGTGAT
```

-continued

TGAAAATCATCGTTTCACCGGTCGTTATCGCGATCTGTATCCGGCAAATGAACTGATCGCACTGCTGGAAGAG

AAAGGTATTGTTTTTCGTGATGGCTCAAACATTCTGCCGAAACTGCTGGAAAATGATGATAGCCATGCAATTG

ATACCATGGTTGCACTGATTCGTAGCGTTCTGCAGATGCGTAATAGCAATGCAGCAACCGGTGAAGATTACAT

TAATAGTCCGGTTCGTGATCTGAATGGTGTTTGTTTTGATAGCCGTTTTCAGAATCCGGAATGGCCGATGGAT

GCAGATGCAAATGGTGCATATCATATTGCACTGAAAGGACAGCTGCTGCTGAACCACCTGAAAGAAAGCAAA

GATCTGAAACTGCAAAACGGCATTAGCAATCAGGATTGGCTGGCATATATCCAAGAACTGCGTAAC

SEQ ID NO.: 469

*E. coli* optimized DNA F870L Cas12a
atgACCCAGTTTGAAGGTTTCACCAATCTGTATCAGGTTAGCAAAACCCTGCGTTTTGAACTG

ATTCCGCAGGGTAAAACCCTGAAACATATTCAAGAACAGGGCTTCATCGAAGAGGATAAAGCACGTAACGAT

CACTACAAAGAACTGAAACCGATTATCGACCGCATCTATAAAACCTATGCAGATCAGTGTCTGCAGCTGGTTC

AGCTGGATTGGGAAAATCTGAGCGCAGCAATTGATAGTTATCGCAAAGAAAAAACCGAAGAAACCCGTAATG

CACTGATTGAAGAACAGGCAACCTATCGTAATGCCATCCATGATTATTTCATTGGTCGTACCGATAATCTGACC

GATGCAATTAACAAACGTCACGCCGAAATCTATAAAGGCCTGTTTAAAGCCGAACTGTTTAATGGCAAAGTTC

TGAAACAGCTGGGCACCGTTACCACCACCGAACATGAAAATGCACTGCTGCGTAGCTTTGATAAATTCACCAC

CTATTTCAGCGGCTTTTATGAGAATCGCAAAAACGTGTTTAGCGCAGAAGATATTAGCACCGCAATTCCGCAT

CGTATTGTGCAGGATAATTTCCCGAAATTCAAAGAGAACTGCCACATTTTTACCCGTCTGATTACCGCAGTTCC

GAGCCTGCGTGAACATTTTGAAAACGTTAAAAAAGCCATCGGCATCTTTGTTAGCACCAGCATTGAAGAAGTT

TTTAGCTTCCCGTTTTACAATCAGCTGCTGACCCAGACCCAGATTGATCTGTATAACCAACTGCTGGGTGGTAT

TAGCCGTGAAGCAGGCACCGAAAAAATCAAAGGTCTGAATGAAGTGCTGAATCTGGCCATTCAGAAAAATGA

TGAAACCGCACATATTATTGCAAGCCTGCCGCATCGTTTTATTCCGCTGTTCAAACAAATTCTGAGCGATCGTA

ATACCCTGAGCTTTATTCTGGAAGAATTCAAATCCGATGAAGAGGTGATTCAGAGCTTTTGCAAATACAAAAC

GCTGCTGCGCAATGAAAATGTTCTGGAAACTGCCGAAGCACTGTTTAACGAACTGAATAGCATTGATCTGACC

CACATCTTTATCAGCCACAAAAAACTGGAAACCATTTCAAGCGCACTGTGTGATCATTGGGATACCCTGCGTA

ATGCCCTGTATGAACGTCGTATTAGCGAACTGACCGGTAAAATTACCAAAAGCGCGAAAGAAAAAGTTCAGC

GCAGTCTGAAACATGAGGATATTAATCTGCAAGAGATTATTAGCGCAGCCGGTAAAGAACTGTCAGAAGCAT

TTAAACAGAAAACCAGCGAAATTCTGTCACATGCACATGCAGCACTGGATCAGCCGCTGCCGACCACCCTGAA

AAAACAAGAAGAAAAGAAATCCTGAAAAGCCAGCTGGATAGCCTGCTGGGTCTGTATCATCTGCTGGACTG

GTTTGCAGTTGATGAAAGCAATGAAGTTGATCCGGAATTTAGCGCACGTCTGACCGGCATTAAACTGGAAAT

GGAACCGAGCCTGAGCTTTTATAACAAAGCCCGTAATTATGCCACCAAAAAACCGTATAGCGTCGAAAAATTC

AAACTGAACTTTCAGATGCCGACCCTGGCAAGCGGTTGGGATGTTAATAAAGAAAAAAACAACGGTGCCATC

CTGTTCGTGAAAAATGGCCTGTATTATCTGGGTATTATGCCGAAACAGAAAGGTCGTTATAAAGCGCTGAGCT

TTGAACCGACGGAAAAAACCAGTGAAGGTTTTGATAAAATGTACTACGACTATTTTCCGGATGCAGCCAAAAT

GATTCCGAAATGTAGCACCCAGCTGAAAGCAGTTACCGCACATTTTCAGACCCATACCACCCCGATTCTGCTGA

GCAATAACTTTATTGAACCGCTGGAAATCACCAAAGAGATCTACGATCTGAATAACCCGGAAAAAGAGCCGA

AAAAATTCCAGACCGCATATGCAAAAAAACCGGTGATCAGAAAGGTTATCGTGAAGCGCTGTGTAAATGGA

TTGATTTCACCCGTGATTTTCTGAGCAAATACACCAAAACCACCAGTATCGATCTGAGCAGCCTGCGTCCGAGC

AGCCAGTATAAAGATCTGGGCGAATATTATGCAGAACTGAATCCGCTGCTGTATCATATTAGCTTTCAGCGTA

TTGCCGAGAAAGAAATCATGGACGCAGTTGAAACCGGTAAACTGTACCTGTTCCAGATCTACAATAAAGATTT

TGCCAAAGGCCATCATGGCAAACCGAATCTGCATACCCTGTATTGGACCGGTCTGTTTAGCCCTGAAAATCTG

GCAAAAACCTCGATTAAACTGAATGGTCAGGCGGAACTGTTTTATCGTCCGAAAAGCCGTATGAAACGTATG

GCACATCGTCTGGGTGAAAAAATGCTGAACAAAAAACTGAAAGACCAGAAAACCCCGATCCCGGATACACTG

-continued

```
TATCAAGAACTGTATGATTATGTGAACCATCGTCTGAGCCATGATCTGAGTGATGAAGCACGTGCCCTGCTGC
CGAATGTTATTACCAAAGAAGTTAGCCACGAGATCATTAAAGATCGTCGTTTTACCAGCGACAAATTCCTGTTT
CATGTGCCGATTACCCTGAATTATCAGGCAGCAAATAGCCCGAGCAAATTTAACCAGCGTGTTAATGCATATC
TGAAAGAACATCCAGAAACGCCGATTATTGGTATTGATCGTGGTGAACGTAACCTGATTTATATCACCGTTATT
GATAGCACCGGCAAAATCCTGGAACAGCGTAGCCTGAATACCATTCAGCAGTTTGATTACCAGAAAAAACTG
GATAATCGCGAGAAAGAACGTGTTGCAGCACGTCAGGCATGGTCAGTTGTTGGTACAATTAAAGACCTGAAA
CAGGGTTATCTGAGCCAGGTTATTCATGAAATTGTGGATCTGATGATTCACTATCAGGCCGTTGTTGTGCTGG
AAAACCTGAATTTTGGCTTTAAAAGCAAACGTACCGGCATTGCAGAAAAAGCAGTTTATCAGCAGTTCGAGAA
AATGCTGATTGACAAACTGAATTGCCTGGTGCTGAAAGATTATCCGGCTGAAAAAGTTGGTGGTGTTCTGAAT
CCGTATCAGCTGACCGATCAGTTTACCAGCTTTGCAAAAATGGGCACCCAGAGCGGATTTCTGTTTTATGTTCC
GGCACCGTATACGAGCAAAATTGATCCGCTGACCGGTTTTGTTGATCCGTTTGTTTGGAAAACCATCAAAAAC
CATGAAAGCCGCAAACATTTTCTGGAAGGTTTCGATTTTCTGCATTACGACGTTAAAACGGGTGATTTCATCCT
GCACTTTAAAATGAATCGCAATCTGAGTTTTCAGCGTGGCCTGCCTGGTTTTATGCCTGCATGGGATATTGTGT
TTGAGAAAAACGAAACACAGTTCGATGCAAAAGGCACCCCGTTTATTGCAGGTAAACGTATTGTTCCGGTGAT
TGAAAATCATCGTTTCACCGGTCGTTATCGCGATCTGTATCCGGCAAATGAACTGATCGCACTGCTGGAAGAG
AAAGGTATTGTTTTTCGTGATGGCTCAAACATTCTGCCGAAACTGCTGGAAAATGATGATAGCCATGCAATTG
ATACCATGGTTGCACTGATTCGTAGCGTTCTGCAGATGCGTAATAGCAATGCAGCAACCGGTGAAGATTACAT
TAATAGTCCGGTTCGTGATCTGAATGGTGTTTGTTTTGATAGCCGTTTTCAGAATCCGGAATGGCCGATGGAT
GCAGATGCAAATGGTGCATATCATATTGCACTGAAAGGACAGCTGCTGCTGAACCACCTGAAAGAAAGCAAA
GATCTGAAACTGCAAAACGGCATTAGCAATCAGGATTGGCTGGCATATATCCAAGAACTGCGTAAC
```

SEQ ID NO.: 470

Human optimized DNA M537R Cas12a
```
atgACCCAGTTTGAAGGTTTCACCAATCTGTATCAGGTTAGCAAAACCCTGCGTTTTGAACTG
ATTCCGCAGGGTAAAACCCTGAAACATATTCAAGAACAGGGCTTCATCGAAGAGGATAAAGCACGTAACGAT
CACTACAAAGAACTGAAACCGATTATCGACCGCATCTATAAAACCTATGCAGATCAGTGTCTGCAGCTGGTTC
AGCTGGATTGGGAAAATCTGAGCGCAGCAATTGATAGTTATCGCAAAGAAAAAACCGAAGAAACCCGTAATG
CACTGATTGAAGAACAGGCAACCTATCGTAATGCCATCCATGATTATTTCATTGGTCGTACCGATAATCTGACC
GATGCAATTAACAAACGTCACGCCGAAATCTATAAAGGCCTGTTTAAAGCCGAACTGTTTAATGGCAAAGTTC
TGAAACAGCTGGGCACCGTTACCACCACCGAACATGAAAATGCACTGCTGCGTAGCTTTGATAAATTCACCAC
CTATTTCAGCGGCTTTTATGAGAATCGCAAAAACGTGTTTAGCGCAGAAGATATTAGCACCGCAATTCCGCAT
CGTATTGTGCAGGATAATTTCCCGAAATTCAAAGAGAACTGCCACATTTTTACCCGTCTGATTACCGCAGTTCC
GAGCCTGCGTGAACATTTTGAAAACGTTAAAAAAGCCATCGGCATCTTTGTTAGCACCAGCATTGAAGAAGTT
TTTAGCTTCCCGTTTTACAATCAGCTGCTGACCCAGACCCAGATTGATCTGTATAACCAACTGCTGGGTGGTAT
TAGCCGTGAAGCAGGCACCGAAAAAATCAAAGGTCTGAATGAAGTGCTGAATCTGGCCATTCAGAAAAATGA
TGAAACCGCACATATTATTGCAAGCCTGCCGCATCGTTTTATTCCGCTGTTCAAACAAATTCTGAGCGATCGTA
ATACCCTGAGCTTTATTCTGGAAGAATTCAAATCCGATGAAGAGGTGATTCAGAGCTTTTGCAAATACAAAAC
GCTGCTGCGCAATGAAAATGTTCTGGAAACTGCCGAAGCACTGTTTAACGAACTGAATAGCATTGATCTGACC
CACATCTTTATCAGCCACAAAAAACTGGAAACCATTTCAAGCGCACTGTGTGATCATTGGGATACCCTGCGTA
ATGCCCTGTATGAACGTCGTATTAGCGAACTGACCGGTAAAATTACCAAAAGCGCGAAGAAAAAGTTCAGC
GCAGTCTGAAACATGAGGATATTAATCTGCAAGAGATTATTAGCGCAGCCGGTAAAGAACTGTCAGAAGCAT
TTAAACAGAAAACCAGCGAAATTCTGTCACATGCACATGCAGCACTGGATCAGCCGCTGCCGACCACCCTGAA
```

-continued

```
AAAACAAGAAGAAAAAGAAATCCTGAAAAGCCAGCTGGATAGCCTGCTGGGTCTGTATCATCTGCTGGACTG

GTTTGCAGTTGATGAAAGCAATGAAGTTGATCCGGAATTTAGCGCACGTCTGACCGGCATTAAACTGGAAAT

GGAACCGAGCCTGAGCTTTTATAACAAAGCCCGTAATTATGCCACCAAAAAACCGTATAGCGTCGAAAAATTC

AAACTGAACTTTCAGCGTCCGACCCTGGCAAGCGGTTGGGATGTTAATAAAGAAAAAAACAACGGTGCCATC

CTGTTCGTGAAAAATGGCCTGTATTATCTGGGTATTATGCCGAAACAGAAAGGTCGTTATAAAGCGCTGAGCT

TTGAACCGACGGAAAAAACCAGTGAAGGTTTTGATAAAATGTACTACGACTATTTTCCGGATGCAGCCAAAAT

GATTCCGAAATGTAGCACCCAGCTGAAAGCAGTTACCGCACATTTTCAGACCCATACCACCCCGATTCTGCTGA

GCAATAACTTTATTGAACCGCTGGAAATCACCAAAGAGATCTACGATCTGAATAACCCGGAAAAAGAGCCGA

AAAAATTCCAGACCGCATATGCAAAAAAACCGGTGATCAGAAAGGTTATCGTGAAGCGCTGTGTAAATGGA

TTGATTTCACCCGTGATTTTCTGAGCAAATACACCAAAACCACCAGTATCGATCTGAGCAGCCTGCGTCCGAGC

AGCCAGTATAAAGATCTGGGCGAATATTATGCAGAACTGAATCCGCTGCTGTATCATATTAGCTTTCAGCGTA

TTGCCGAGAAAGAAATCATGGACGCAGTTGAAACCGGTAAACTGTACCTGTTCCAGATCTACAATAAAGATTT

TGCCAAAGGCCATCATGGCAAACCGAATCTGCATACCCTGTATTGGACCGGTCTGTTTAGCCCTGAAAATCTG

GCAAAAACCTCGATTAAACTGAATGGTCAGGCGGAACTGTTTTATCGTCCGAAAAGCCGTATGAAACGTATG

GCACATCGTCTGGGTGAAAAAATGCTGAACAAAAAACTGAAAGACCAGAAAACCCCGATCCCGGATACACTG

TATCAAGAACTGTATGATTATGTGAACCATCGTCTGAGCCATGATCTGAGTGATGAAGCACGTGCCCTGCTGC

CGAATGTTATTACCAAAGAAGTTAGCCACGAGATCATTAAAGATCGTCGTTTTACCAGCGACAAATTCTTTTTT

CATGTGCCGATTACCCTGAATTATCAGGCAGCAAATAGCCCGAGCAAATTTAACCAGCGTGTTAATGCATATC

TGAAAGAACATCCAGAAACGCCGATTATTGGTATTGATCGTGGTGAACGTAACCTGATTTATATCACCGTTATT

GATAGCACCGGCAAAATCCTGGAACAGCGTAGCCTGAATACCATTCAGCAGTTTGATTACCAGAAAAAACTG

GATAATCGCGAGAAGAACGTGTTGCAGCACGTCAGGCATGGTCAGTTGTTGGTACAATTAAAGACCTGAAA

CAGGGTTATCTGAGCCAGGTTATTCATGAAATTGTGGATCTGATGATTCACTATCAGGCCGTTGTTGTGCTGG

AAAACCTGAATTTTGGCTTTAAAAGCAAACGTACCGGCATTGCAGAAAAAGCAGTTTATCAGCAGTTCGAGAA

AATGCTGATTGACAAACTGAATTGCCTGGTGCTGAAAGATTATCCGGCTGAAAAAGTTGGTGGTGTTCTGAAT

CCGTATCAGCTGACCGATCAGTTTACCAGCTTTGCAAAAATGGGCACCCAGAGCGGATTTCTGTTTTATGTTCC

GGCACCGTATACGAGCAAAATTGATCCGCTGACCGGTTTTGTTGATCCGTTTGTTTGGAAAACCATCAAAAAC

CATGAAAGCCGCAAACATTTTCTGGAAGGTTTCGATTTTCTGCATTACGACGTTAAAACGGGTGATTTCATCCT

GCACTTTAAAATGAATCGCAATCTGAGTTTTCAGCGTGGCCTGCCTGGTTTTATGCCTGCATGGGATATTGTGT

TTGAGAAAAACGAAACACAGTTCGATGCAAAAGGCACCCCGTTTATTGCAGGTAAACGTATTGTTCCGGTGAT

TGAAAATCATCGTTTCACCGGTCGTTATCGCGATCTGTATCCGGCAAATGAACTGATCGCACTGCTGGAAGAG

AAAGGTATTGTTTTCGTGATGGCTCAAACATTCTGCCGAAACTGCTGGAAAATGATGATAGCCATGCAATTG

ATACCATGGTTGCACTGATTCGTAGCGTTCTGCAGATGCGTAATAGCAATGCAGCAACCGGTGAAGATTACAT

TAATAGTCCGGTTCGTGATCTGAATGGTGTTTGTTTTGATAGCCGTTTTCAGAATCCGGAATGGCCGATGGAT

GCAGATGCAAATGGTGCATATCATATTGCACTGAAAGGACAGCTGCTGCTGAACCACCTGAAAGAAAGCAAA

GATCTGAAACTGCAAAACGGCATTAGCAATCAGGATTGGCTGGCATATATCCAAGAACTGCGTAAC
```

SEQ ID NO.: 471

Human optimized DNA F870L Cas12a

```
atgACCCAGTTTGAAGGTTTCACCAATCTGTATCAGGTTAGCAAAACCCTGCGTTTTGAACTG

ATTCCGCAGGGTAAAACCCTGAAACATATTCAAGAACAGGGCTTCATCGAAGAGGATAAAGCACGTAACGAT

CACTACAAAGAACTGAAACCGATTATCGACCGCATCTATAAAACCTATGCAGATCAGTGTCTGCAGCTGGTTC

AGCTGGATTGGGAAAATCTGAGCGCAGCAATTGATAGTTATCGCAAAGAAAAAACCGAAGAAACCCGTAATG

CACTGATTGAAGAACAGGCAACCTATCGTAATGCCATCCATGATTATTTCATTGGTCGTACCGATAATCTGACC
```

-continued

```
GATGCAATTAACAAACGTCACGCCGAAATCTATAAAGGCCTGTTTAAAGCCGAACTGTTTAATGGCAAAGTTC
TGAAACAGCTGGGCACCGTTACCACCACCGAACATGAAAATGCACTGCTGCGTAGCTTTGATAAATTCACCAC
CTATTTCAGCGGCTTTTATGAGAATCGCAAAAACGTGTTTAGCGCAGAAGATATTAGCACCGCAATTCCGCAT
CGTATTGTGCAGGATAATTTCCCGAAATTCAAAGAGAACTGCCACATTTTTACCCGTCTGATTACCGCAGTTCC
GAGCCTGCGTGAACATTTTGAAAACGTTAAAAAAGCCATCGGCATCTTTGTTAGCACCAGCATTGAAGAAGTT
TTTAGCTTCCCGTTTTACAATCAGCTGCTGACCCAGACCCAGATTGATCTGTATAACCAACTGCTGGGTGGTAT
TAGCCGTGAAGCAGGCACCGAAAAAATCAAAGGTCTGAATGAAGTGCTGAATCTGGCCATTCAGAAAAATGA
TGAAACCGCACATATTATTGCAAGCCTGCCGCATCGTTTTATTCCGCTGTTCAAACAAATTCTGAGCGATCGTA
ATACCCTGAGCTTTATTCTGGAAGAATTCAAATCCGATGAAGAGGTGATTCAGAGCTTTTGCAAATACAAAAC
GCTGCTGCGCAATGAAAATGTTCTGGAAACTGCCGAAGCACTGTTTAACGAACTGAATAGCATTGATCTGACC
CACATCTTTATCAGCCACAAAAAACTGGAAACCATTTCAAGCGCACTGTGTGATCATTGGGATACCCTGCGTA
ATGCCCTGTATGAACGTCGTATTAGCGAACTGACCGGTAAAATTACCAAAAGCGCGAAAGAAAAAGTTCAGC
GCAGTCTGAAACATGAGGATATTAATCTGCAAGAGATTATTAGCGCAGCCGGTAAAGAACTGTCAGAAGCAT
TTAAACAGAAAACCAGCGAAATTCTGTCACATGCACATGCAGCACTGGATCAGCCGCTGCCGACCACCCTGAA
AAAACAAGAAGAAAAGAAATCCTGAAAAGCCAGCTGGATAGCCTGCTGGGTCTGTATCATCTGCTGGACTG
GTTTGCAGTTGATGAAAGCAATGAAGTTGATCCGGAATTTAGCGCACGTCTGACCGGCATTAAACTGGAAAT
GGAACCGAGCCTGAGCTTTTATAACAAAGCCCGTAATTATGCCACCAAAAAACCGTATAGCGTCGAAAAATTC
AAACTGAACTTTCAGATGCCGACCCTGGCAAGCGGTTGGGATGTTAATAAAGAAAAAAACAACGGTGCCATC
CTGTTCGTGAAAAATGGCCTGTATTATCTGGGTATTATGCCGAAACAGAAAGGTCGTTATAAAGCGCTGAGCT
TTGAACCGACGGAAAAAACCAGTGAAGGTTTTGATAAAATGTACTACGACTATTTTCCGGATGCAGCCAAAAT
GATTCCGAAATGTAGCACCCAGCTGAAAGCAGTTACCGCACATTTTCAGACCCATACCACCCCGATTCTGCTGA
GCAATAACTTTATTGAACCGCTGGAAATCACCAAAGAGATCTACGATCTGAATAACCCGGAAAAAGAGCCGA
AAAAATTCCAGACCGCATATGCAAAAAAAACCGGTGATCAGAAAGGTTATCGTGAAGCGCTGTGTAAATGGA
TTGATTTCACCCGTGATTTTCTGAGCAAATACACCAAAACCACCAGTATCGATCTGAGCAGCCTGCGTCCGAGC
AGCCAGTATAAAGATCTGGGCGAATATTATGCAGAACTGAATCCGCTGCTGTATCATATTAGCTTTCAGCGTA
TTGCCGAGAAAGAAATCATGGACGCAGTTGAAACCGGTAAACTGTACCTGTTCCAGATCTACAATAAAGATTT
TGCCAAAGGCCATCATGGCAAACCGAATCTGCATACCCTGTATTGGACCGGTCTGTTTAGCCCTGAAAATCTG
GCAAAAACCTCGATTAAACTGAATGGTCAGGCGGAACTGTTTTATCGTCCGAAAAGCCGTATGAAACGTATG
GCACATCGTCTGGGTGAAAAAATGCTGAACAAAAAACTGAAAGACCAGAAAACCCCGATCCCGGATACACTG
TATCAAGAACTGTATGATTATGTGAACCATCGTCTGAGCCATGATCTGAGTGATGAAGCACGTGCCCTGCTGC
CGAATGTTATTACCAAAGAAGTTAGCCACGAGATCATTAAAGATCGTCGTTTTACCAGCGACAAATTCCTGTTT
CATGTGCCGATTACCCTGAATTATCAGGCAGCAAATAGCCCGAGCAAATTTAACCAGCGTGTTAATGCATATC
TGAAAGAACATCCAGAAACGCCGATTATTGGTATTGATCGTGGTGAACGTAACCTGATTTATATCACCGTTATT
GATAGCACCGGCAAAATCCTGGAACAGCGTAGCCTGAATACCATTCAGCAGTTTGATTACCAGAAAAAACTG
GATAATCGCGAGAAAGAACGTGTTGCAGCACGTCAGGCATGGTCAGTTGTTGGTACAATTAAAGACCTGAAA
CAGGGTTATCTGAGCCAGGTTATTCATGAAATTGTGGATCTGATGATTCACTATCAGGCCGTTGTTGTGCTGG
AAAACCTGAATTTTGGCTTTAAAAGCAAACGTACCGGCATTGCAGAAAAAGCAGTTTATCAGCAGTTCGAGAA
AATGCTGATTGACAAACTGAATTGCCTGGTGCTGAAAGATTATCCGGCTGAAAAAGTTGGTGGTGTTCTGAAT
CCGTATCAGCTGACCGATCAGTTTACCAGCTTTGCAAAAATGGGCACCCAGAGCGGATTTCTGTTTTATGTTCC
GGCACCGTATACGAGCAAAATTGATCCGCTGACCGGTTTTGTTGATCCGTTTGTTTGGAAAACCATCAAAAAC
```

-continued

CATGAAAGCCGCAAACATTTTCTGGAAGGTTTCGATTTTCTGCATTACGACGTTAAAACGGGTGATTTCATCCT

GCACTTTAAAATGAATCGCAATCTGAGTTTTCAGCGTGGCCTGCCTGGTTTTATGCCTGCATGGGATATTGTGT

TTGAGAAAAACGAAACACAGTTCGATGCAAAAGGCACCCCGTTTATTGCAGGTAAACGTATTGTTCCGGTGAT

TGAAAATCATCGTTTCACCGGTCGTTATCGCGATCTGTATCCGGCAAATGAACTGATCGCACTGCTGGAAGAG

AAAGGTATTGTTTTTCGTGATGGCTCAAACATTCTGCCGAAACTGCTGGAAAATGATGATAGCCATGCAATTG

ATACCATGGTTGCACTGATTCGTAGCGTTCTGCAGATGCGTAATAGCAATGCAGCAACCGGTGAAGATTACAT

TAATAGTCCGGTTCGTGATCTGAATGGTGTTTGTTTTGATAGCCGTTTTCAGAATCCGGAATGGCCGATGGAT

GCAGATGCAAATGGTGCATATCATATTGCACTGAAAGGACAGCTGCTGCTGAACCACCTGAAAGAAAGCAAA

GATCTGAAACTGCAAAACGGCATTAGCAATCAGGATTGGCTGGCATATATCCAAGAACTGCGTAAC

SEQ ID NO.: 472
M537R Cas12a AA
MTQFEGFTNLYQVSKTLRFELIPQGKTLKHIQEQGFIEEDKARNDHYKELKPIIDRIYKTYADQCL

QLVQLDWENLSAAIDSYRKEKTEETRNALIEEQATYRNAIHDYFIGRTDNLTDAINKRHAEIYKGLFKAELFNGKVLK

QLGTVTTTEHENALLRSFDKFTTYFSGFYENRKNVFSAEDISTAIPHRIVQDNFPKFKENCHIFTRLITAVPSLREHFEN

VKKAIGIFVSTSIEEVFSFPFYNQLLTQTQIDLYNQLLGGISREAGTEKIKGLNEVLNLAIQKNDETAHIIASLPHRFIPLF

KQILSDRNTLSFILEEFKSDEEVIQSFCKYKTLLRNENVLETAEALFNELNSIDLTHIFISHKKLETISSALCDHWDTLRNA

LYERRISELTGKITKSAKEKVQRSLKHEDINLQEIISAAGKELSEAFKQKTSEILSHAHAALDQPLPTTLKKQEEKEILKSQ

LDSLLGLYHLLDWFAVDESNEVDPEFSARLTGIKLEMEPSLSFYNKARNYATKKPYSVEKFKLNFQRPTLASGWDVN

KEKNNGAILFVKNGLYYLGIMPKQKGRYKALSFEPTEKTSEGFDKMYYDYFPDAAKMIPKCSTQLKAVTAHFQTHT

TPILLSNNFIEPLEITKEIYDLNNPEKEPKKFQTAYAKKTGDQKGYREALCKWIDFTRDFLSKYTKTTSIDLSSLRPSSQY

KDLGEYYAELNPLLYHISFQRIAEKEIMDAVETGKLYLFQIYNKDFAKGHHGKPNLHTLYWTGLFSPENLAKTSIKLN

GQAELFYRPKSRMKRMAHRLGEKMLNKKLKDQKTPIPDTLYQELYDYVNHRLSHDLSDEARALLPNVITKEVSHEII

KDRRFTSDKFFFHVPITLNYQAANSPSKFNQRVNAYLKEHPETPIIGIDRGERNLIYITVIDSTGKILEQRSLNTIQQFD

YQKKLDNREKERVAARQAWSVVGTIKDLKQGYLSQVIHEIVDLMIHYQAVVVLENLNFGFKSKRTGIAEKAVYQQF

EKMLIDKLNCLVLKDYPAEKVGGVLNPYQLTDQFTSFAKMGTQSGFLFYVPAPYTSKIDPLTGFVDPFVWKTIKNHE

SRKHFLEGFDFLHYDVKTGDFILHFKMNRNLSFQRGLPGFMPAWDIVFEKNETQFDAKGTPFIAGKRIVPVIENHR

FTGRYRDLYPANELIALLEEKGIVFRDGSNILPKLLENDDSHAIDTMVALIRSVLQMRNSNAATGEDYINSPVRDLNG

VCFDSRFQNPEWPMDADANGAYHIALKGQLLLNHLKESKDLKLQNGISNQDWLAYIQELRN

SEQ ID NO.: 473
F870L Cas12a AA
MTQFEGFTNLYQVSKTLRFELIPQGKTLKHIQEQGFIEEDKARNDHYKELKPIIDRIYKTYADQCL

QLVQLDWENLSAAIDSYRKEKTEETRNALIEEQATYRNAIHDYFIGRTDNLTDAINKRHAEIYKGLFKAELFNGKVLK

QLGTVTTTEHENALLRSFDKFTTYFSGFYENRKNVFSAEDISTAIPHRIVQDNFPKFKENCHIFTRLITAVPSLREHFEN

VKKAIGIFVSTSIEEVFSFPFYNQLLTQTQIDLYNQLLGGISREAGTEKIKGLNEVLNLAIQKNDETAHIIASLPHRFIPLF

KQILSDRNTLSFILEEFKSDEEVIQSFCKYKTLLRNENVLETAEALFNELNSIDLTHIFISHKKLETISSALCDHWDTLRNA

LYERRISELTGKITKSAKEKVQRSLKHEDINLQEIISAAGKELSEAFKQKTSEILSHAHAALDQPLPTTLKKQEEKEILKSQ

LDSLLGLYHLLDWFAVDESNEVDPEFSARLTGIKLEMEPSLSFYNKARNYATKKPYSVEKFKLNFQMPTLASGWDV

NKEKNNGAILFVKNGLYYLGIMPKQKGRYKALSFEPTEKTSEGFDKMYYDYFPDAAKMIPKCSTQLKAVTAHFQTH

TTPILLSNNFIEPLEITKEIYDLNNPEKEPKKFQTAYAKKTGDQKGYREALCKWIDFTRDFLSKYTKTTSIDLSSLRPSSQ

YKDLGEYYAELNPLLYHISFQRIAEKEIMDAVETGKLYLFQIYNKDFAKGHHGKPNLHTLYWTGLFSPENLAKTSIKLN

GQAELFYRPKSRMKRMAHRLGEKMLNKKLKDQKTPIPDTLYQELYDYVNHRLSHDLSDEARALLPNVITKEVSHEII

KDRRFTSDKFLFHVPITLNYQAANSPSKFNQRVNAYLKEHPETPIIGIDRGERNLIYITVIDSTGKILEQRSLNTIQQFD

YQKKLDNREKERVAARQAWSVVGTIKDLKQGYLSQVIHEIVDLMIHYQAVVVLENLNFGFKSKRTGIAEKAVYQQF

EKMLIDKLNCLVLKDYPAEKVGGVLNPYQLTDQFTSFAKMGTQSGFLFYVPAPYTSKIDPLTGFVDPFVWKTIKNHE

SRKHFLEGFDFLHYDVKTGDFILHFKMNRNLSFQRGLPGFMPAWDIVFEKNETQFDAKGTPFIAGKRIVPVIENHR

FTGRYRDLYPANELIALLEEKGIVFRDGSNILPKLLENDDSHAIDTMVALIRSVLQMRNSNAATGEDYINSPVRDLNG

VCFDSRFQNPEWPMDADANGAYHIALKGQLLLNHLKESKDLKLQNGISNQDWLAYIQELRN

Example 6

Rational Design of Fusion Cas12a Polypeptides

Fusion Cas12/a polypeptides having additional motifs enabling nuclear localization into eukaryotic cells (collectively, "NLS" or "NLS sequences"), and/or purification and label detection motifs (collectively, "affinity tags") fall within the scope of the present invention. Exemplary nuclear localization signals ("NLS" or "NLS sequences") are well known in the art and include those listed identified by polynucleotide and amino acid sequences depicted in Table 6.

TABLE 6

Exemplary NLS sequences

| SEQ ID NO.: | NLS Name | Sequence (5'→3' or N→C) |
|---|---|---|
| 474 | SV40 | CCGAAAAAAAAACGTAAAGTTGG |
| 475 | SV40 | PKKKRKV |
| 476 | OpT | AGCAGTGATGATGAAGCAACCGCAGATAGCCAGCATGCAGCACCGCCTAAAAAGAAACGTAAAGTT |
| 477 | OpT | SSDDEATADSQHAAPPKKKRKV |
| 478 | aNLS | CCGCCTCCGAAACGTCCGCGTCTGGAT |
| 479 | aNLS | PPPKRPRLD |
| 480 | BIP1 | AAACGTCCGGCAGCAACCAAAAAAGCAGGTCAGGCAAAAAAGAAAAAA |
| 481 | BIP1 | KRPAATKKAGQAKKKK |
| 482 | BIP2 | AAACGTACCGCAGATGGTAGCGAATTTGAAAGCCCGAAAAAAAAGCGTAAGGTGGAA |
| 483 | BIP2 | KRTADGSEFESPKKKRKVE |

Exemplary purification and/or label detection motifs include affinity tags that are also well known in the art. Often, additional amino acid linkers inserted before or after the additional motifs can provide improvements in expression and/or stability of the expressed fusion Cas12/a polypeptide. Two examples of affinity tags are defined by polynucleotide and amino acid sequences depicted below in Table 7.

TABLE 7

Exemplary affinity tags

| SEQ ID NO.: | Affinity Tag Name | Sequence (5'→3' or N→C) |
|---|---|---|
| 484 | V5 | GGTAAACCGATTCCGAATCCGCTGCTGGGTCTGGATAGCACC |

TABLE 7-continued

Exemplary affinity tags

| SEQ ID NO.: | Affinity Tag Name | Sequence (5'→3' or N→C) |
|---|---|---|
| 485 | V5 | GKPIPNPLLGLDST |
| 486 | HIS | CACCACCACCACCACCAC |
| 487 | HIS | HHHHHH |

Fusion Cas12a polypeptides that include a nuclear localization signal, linker amino acids and/or affinity tags can be readily constructed using chemical polypeptide methods or expressed from engineered polynucleotides encoding in-frame polypeptides created with recombinant DNA technology. Such technologies are well known and within the purview of one skilled in the art. Working examples of such polynucleotides and polypeptides are illustrated by SEQ ID NOs.: 5-30. Fusion Cas12a polypeptide variants that encode the open reading frames of SEQ ID NOs.: 59-245 having nuclear localization sequences and/or affinity tags and optionally amino acid linkers as needed fall within the scope of this disclosure. Exemplary Cas12a variants having nuclear localization signals are presented below.

Briefly, the method of site directed mutagenesis (SDM) was employed to create the expression constructs having As Cas12a coding sequences with different nuclear localization signals (NLS's). Site directed mutagenesis was performed by designing complimentary primers that encompass the desired nucleotide base change(s), along with flanking plasmid vector sequence, wherein each flanking region has a melting temperature ($T_m$) of at least 60° C. A polymerase chain reaction (PCR) run was then performed using standard cycling conditions for a total of 16 cycles. The restriction enzyme, DPN I, was added to digest away the starting plasmid vector material so only the new product containing the base changes remain. After DPN I treatment, a small amount of the PCR product was transformed into competent E. coli cells, recovered in SOC media and plated onto kanamycin resistance Luria Broth (LB) agar plates. Colonies were screened using the Sanger sequencing method to verify correct base changes in selected clones.

SEQ ID NO.: 488
E. coli optimized DNA WT Cas12a with NLS linkers
atgACCCAGTTTGAAGGTTTCACCAATCTGTATCAGGTTAGCAAAACCCT

GCGTTTTGAACTGATTCCGCAGGGTAAAACCCTGAAACATATTCAAGAAC

AGGGCTTCATCGAAGAGGATAAAGCACGTAACGATCACTACAAAGAACTG

AAACCGATTATCGACCGCATCTATAAAACCTATGCAGATCAGTGTCTGCA

GCTGGTTCAGCTGGATTGGGAAAATCTGAGCGCAGCAATTGATAGTTATC

GCAAAGAAAAAACCGAAGAAACCCGTAATGCACTGATTGAAGAACAGGCA

```
ACCTATCGTAATGCCATCCATGATTATTTCATTGGTCGTACCGATAATCT
GACCGATGCAATTAACAAACGTCACGCCGAAATCTATAAAGGCCTGTTTA
AAGCCGAACTGTTTAATGGCAAAGTTCTGAAACAGCTGGGCACCGTTACC
ACCACCGAACATGAAAATGCACTGCTGCGTAGCTTTGATAAATTCACCAC
CTATTTCAGCGGCTTTTATGAGAATCGCAAAAACGTGTTTAGCGCAGAAG
ATATTAGCACCGCAATTCCGCATCGTATTGTGCAGGATAATTTCCCGAAA
TTCAAAGAGAACTGCCACATTTTTACCCGTCTGATTACCGCAGTTCCGAG
CCTGCGTGAACATTTTGAAAACGTTAAAAAAGCCATCGGCATCTTTGTTA
GCACCAGCATTGAAGAAGTTTTTAGCTTCCCGTTTTACAATCAGCTGCTG
ACCCAGACCCAGATTGATCTGTATAACCAACTGCTGGGTGGTATTAGCCG
TGAAGCAGGCACCGAAAAAATCAAAGGTCTGAATGAAGTGCTGAATCTGG
CCATTCAGAAAAATGATGAAACCGCACATATTATTGCAAGCCTGCCGCAT
CGTTTTATTCCGCTGTTCAAACAAATTCTGAGCGATCGTAATACCCTGAG
CTTTATTCTGGAAGAATTCAAATCCGATGAAGAGGTGATTCAGAGCTTTT
GCAAATACAAAACGCTGCTGCGCAATGAAAATGTTCTGGAAACTGCCGAA
GCACTGTTTAACGAACTGAATAGCATTGATCTGACCCACATCTTTATCAG
CCACAAAAAACTGGAAACCATTTCAAGCGCACTGTGTGATCATTGGGATA
CCCTGCGTAATGCCCTGTATGAACGTCGTATTAGCGAACTGACCGGTAAA
ATTACCAAAAGCGCGAAAGAAAAAGTTCAGCGCAGTCTGAAACATGAGGA
TATTAATCTGCAAGAGATTATTAGCGCAGCCGGTAAAGAACTGTCAGAAG
CATTTAAACAGAAAACCAGCGAAATTCTGTCACATGCACATGCAGCACTG
GATCAGCCGCTGCCGACCACCCTGAAAAAACAAGAAGAAAAAGAAATCCT
GAAAAGCCAGCTGGATAGCCTGCTGGGTCTGTATCATCTGCTGGACTGGT
TTGCAGTTGATGAAAGCAATGAAGTTGATCCGGAATTTAGCGCACGTCTG
ACCGGCATTAAACTGGAAATGGAACCGAGCCTGAGCTTTTATAACAAAGC
CCGTAATTATGCCACCAAAAAACCGTATAGCGTCGAAAAATTCAAACTGA
ACTTTCAGATGCCGACCCTGGCAAGCGGTTGGGATGTTAATAAAGAAAAA
AACAACGGTGCCATCCTGTTCGTGAAAAATGGCCTGTATTATCTGGGTAT
TATGCCGAAACAGAAAGGTCGTTATAAAGCGCTGAGCTTTGAACCGACGG
AAAAAACCAGTGAAGGTTTTGATAAAATGTACTACGACTATTTTCCGGAT
GCAGCCAAAATGATTCCGAAATGTAGCACCCAGCTGAAAGCAGTTACCGC
ACATTTTCAGACCCATACCACCCCGATTCTGCTGAGCAATAACTTTATTG
AACCGCTGGAAATCACCAAAGAGATCTACGATCTGAATAACCCGGAAAAA
GAGCCGAAAAAATTCCAGACCGCATATGCAAAAAAACCGGTGATCAGAA
AGGTTATCGTGAAGCGCTGTGTAAATGGATTGATTTCACCCGTGATTTTC
TGAGCAAATACACCAAAACCACCAGTATCGATCTGAGCAGCCTGCGTCCG
AGCAGCCAGTATAAAGATCTGGGCGAATATTATGCAGAACTGAATCCGCT
GCTGTATCATATTAGCTTTCAGCGTATTGCCGAGAAAGAAATCATGGACG
CAGTTGAAACCGGTAAACTGTACCTGTTCCAGATCTACAATAAAGATTTT
GCCAAAGGCCATCATGGCAAACCGAATCTGCATACCCTGTATTGGACCGG
TCTGTTTAGCCCTGAAAATCTGGCAAAAACCTCGATTAAACTGAATGGTC

AGGCGGAACTGTTTTATCGTCCGAAAAGCCGTATGAAACGTATGGCACAT
CGTCTGGGTGAAAAAATGCTGAACAAAAAACTGAAAGACCAGAAAACCCC
GATCCCGGATACACTGTATCAAGAACTGTATGATTATGTGAACCATCGTC
TGAGCCATGATCTGAGTGATGAAGCACGTGCCCTGCTGCCGAATGTTATT
ACCAAAGAAGTTAGCCACGAGATCATTAAAGATCGTCGTTTTACCAGCGA
CAAATTCTTTTTTCATGTGCCGATTACCCTGAATTATCAGGCAGCAAATA
GCCCGAGCAAATTTAACCAGCGTGTTAATGCATATCTGAAAGAACATCCA
GAAACGCCGATTATTGGTATTGATCGTGGTGAACGTAACCTGATTTATAT
CACCGTTATTGATAGCACCGGCAAAATCCTGGAACAGCGTAGCCTGAATA
CCATTCAGCAGTTTGATTACCAGAAAAAACTGGATAATCGCGAGAAAGAA
CGTGTTGCAGCACGTCAGGCATGGTCAGTTGTTGGTACAATTAAAGACCT
GAAACAGGGTTATCTGAGCCAGGTTATTCATGAAATTGTGGATCTGATGA
TTCACTATCAGGCCGTTGTTGTGCTGGAAAACCTGAATTTTGGCTTTAAA
AGCAAACGTACCGGCATTGCAGAAAAAGCAGTTTATCAGCAGTTCGAGAA
AATGCTGATTGACAAACTGAATTGCCTGGTGCTGAAAGATTATCCGGCTG
AAAAAGTTGGTGGTGTTCTGAATCCGTATCAGCTGACCGATCAGTTTACC
AGCTTTGCAAAAATGGGCACCCAGAGCGGATTTCTGTTTTATGTTCCGGC
ACCGTATACGAGCAAAATTGATCCGCTGACCGGTTTTGTTGATCCGTTTG
TTTGGAAAACCATCAAAAACCATGAAAGCCGCAAACATTTTCTGGAAGGT
TTCGATTTTCTGCATTACGACGTTAAAACGGGTGATTTCATCCTGCACTT
TAAAATGAATCGCAATCTGAGTTTTCAGCGTGGCCTGCCTGGTTTTATGC
CTGCATGGGATATTGTGTTTGAGAAAAACGAAACACAGTTCGATGCAAAA
GGCACCCCGTTTATTGCAGGTAAACGTATTGTTCCGGTGATTGAAAATCA
TCGTTTCACCGGTCGTTATCGCGATCTGTATCCGGCAAATGAACTGATCG
CACTGCTGGAAGAGAAAGGTATTGTTTTCGTGATGGCTCAAACATTCTG
CCGAAACTGCTGGAAAATGATGATAGCCATGCAATTGATACCATGGTTGC
ACTGATTCGTAGCGTTCTGCAGATGCGTAATAGCAATGCAGCAACCGGTG
AAGATTACATTAATAGTCCGGTTCGTGATCTGAATGGTGTTTGTTTTGAT
AGCCGTTTTCAGAATCCGGAATGGCCGATGGATGCAGATGCAAATGGTGC
ATATCATATTGCACTGAAAGGACAGCTGCTGCTGAACCACCTGAAAGAAA
GCAAAGATCTGAAACTGCAAAACGGCATTAGCAATCAGGATTGGCTGGCA
TATATCCAAGAACTGCGTAAC<ins>GGTCGTAGCAGTGATGATGAAGCAACCGC</ins>
<ins>AGATAGCCAGCATGCAGCACCGCCTAAAAAGAAACGTAAAGTTGGTGGTA</ins>
<ins>GCGGTGGTTCAGGTGGTAGTGGCGGTAGTGGTGGCTCAGGGGGTTCTGGT</ins>
<ins>GGCTCTGGTGGTAGC</ins>ctcgag*caccaccaccaccaccac*
```

The underlined sequences refer to nucleotides encoding amino acid linker sequences. The double-underlined sequences refer to nucleotides encoding nuclear localization sequences (NLS linker). The italicized sequences refer to nucleotides encoding amino acid affinity tag sequences ((HIS)$_6$).

SEQ ID NO. 489
E. coli optimized DNA M537R F870L Cas12a
with NLS linkers
atgACCCAGTTTGAAGGTTTCACCAATCTGTATCAGGTTAGCAAAACCCT
GCGTTTTGAACTGATTCCGCAGGGTAAAACCCTGAAACATATTCAAGAAC
AGGGCTTCATCGAAGAGGATAAAGCACGTAACGATCACTACAAAGAACTG
AAACCGATTATCGACCGCATCTATAAAACCTATGCAGATCAGTGTCTGCA
GCTGGTTCAGCTGGATTGGGAAAATCTGAGCGCAGCAATTGATAGTTATC
GCAAAGAAAAACCGAAGAAACCCGTAATGCACTGATTGAAGAACAGGCA
ACCTATCGTAATGCCATCCATGATTATTTCATTGGTCGTACCGATAATCT
GACCGATGCAATTAACAAACGTCACGCCGAAATCTATAAAGGCCTGTTTA
AGCCGAACTGTTTAATGGCAAAGTTCTGAAACAGCTGGGCACCGTTACC
ACCACCGAACATGAAAATGCACTGCTGCGTAGCTTTGATAAATTCACCAC
CTATTTCAGCGGCTTTTATGAGAATCGCAAAAACGTGTTTAGCGCAGAAG
ATATTAGCACCGCAATTCCGCATCGTATTGTGCAGGATAATTTCCCGAAA
TTCAAAGAGAACTGCCACATTTTTACCCGTCTGATTACCGCAGTTCCGAG
CCTGCGTGAACATTTTGAAAACGTTAAAAAAGCCATCGGCATCTTTGTTA
GCACCAGCATTGAAGAAGTTTTTAGCTTCCCGTTTTACAATCAGCTGCTG
ACCCAGACCCAGATTGATCTGTATAACCAACTGCTGGGTGGTATTAGCCG
TGAAGCAGGCACCGAAAAAATCAAAGGTCTGAATGAAGTGCTGAATCTGG
CCATTCAGAAAAATGATGAAACCGCACATATTATTGCAAGCCTGCCGCAT
CGTTTTATTCCGCTGTTCAAACAAATTCTGAGCGATCGTAATACCCTGAG
CTTTATTCTGGAAGAATTCAAATCCGATGAAGAGGTGATTCAGAGCTTTT
GCAAATACAAAACGCTGCTGCGCAATGAAAATGTTCTGGAAACTGCCGAA
GCACTGTTTAACGAACTGAATAGCATTGATCTGACCCACATCTTTATCAG
CCACAAAAAACTGGAAACCATTTCAAGCGCACTGTGTGATCATTGGGATA
CCCTGCGTAATGCCCTGTATGAACGTCGTATTAGCGAACTGACCGGTAAA
ATTACCAAAAGCGCGAAAGAAAAAGTTCAGCGCAGTCTGAAACATGAGGA
TATTAATCTGCAAGAGATTATTAGCGCAGCCGGTAAAGAACTGTCAGAAG
CATTTAAACAGAAAACCAGCGAAATTCTGTCACATGCACATGCAGCACTG
GATCAGCCGCTGCCGACCACCCTGAAAAAACAAGAAGAAAAAGAAATCCT
GAAAAGCCAGCTGGATAGCCTGCTGGGTCTGTATCATCTGCTGGACTGGT
TTGCAGTTGATGAAAGCAATGAAGTTGATCCGGAATTTAGCGCACGTCTG
ACCGGCATTAAACTGGAAATGGAACCGAGCCTGAGCTTTTATAACAAAGC
CCGTAATTATGCCACCAAAAAACCGTATAGCGTCGAAAAATTCAAACTGA
ACTTTCAG<u>CGT</u>CCGACCCTGGCAAGCGGTTGGGATGTTAATAAAGAAAAA
AACAACGGTGCCATCCTGTTCGTGAAAAATGGCCTGTATTATCTGGGTAT
TATGCCGAAACAGAAAGGTCGTTATAAAGCGCTGAGCTTTGAACCGACGG
AAAAAAACCAGTGAAGGTTTTGATAAAATGTACTACGACTATTTTCCGGAT
GCAGCCAAAATGATTCCGAAATGTAGCACCCAGCTGAAAGCAGTTACCGC
ACATTTTCAGACCCATACCACCCCGATTCTGCTGAGCAATAACTTTATTG
AACCGCTGGAAATCACCAAAGAGATCTACGATCTGAATAACCCGGAAAAA GAGCCGAAAAAATTCCAGACCGCATATGCAAAAAAAACCGGTGATCAGAA
AGGTTATCGTGAAGCGCTGTGTAAATGGATTGATTTCACCCGTGATTTTC
TGAGCAAATACACCAAAACCACCAGTATCGATCTGAGCAGCCTGCGTCCG
AGCAGCCAGTATAAAGATCTGGGCGAATATTATGCAGAACTGAATCCGCT
GCTGTATCATATTAGCTTTCAGCGTATTGCCGAGAAAGAAATCATGGACG
CAGTTGAAACCGGTAAACTGTACCTGTTCCAGATCTACAATAAAGATTTT
GCCAAAGGCCATCATGGCAAACCGAATCTGCATACCCTGTATTGGACCGG
TCTGTTTAGCCCTGAAAATCTGGCAAAAACCTCGATTAAACTGAATGGTC
AGGCGGAACTGTTTTATCGTCCGAAAAGCCGTATGAAACGTATGGCACAT
CGTCTGGGTGAAAAAATGCTGAACAAAAAACTGAAAGACCAGAAAACCCC
GATCCCGGATACACTGTATCAAGAACTGTATGATTATGTGAACCATCGTC
TGAGCCATGATCTGAGTGATGAAGCACGTGCCCTGCTGCCGAATGTTATT
ACCAAAGAAGTTAGCCACGAGATCATTAAAGATCGTCGTTTTACCAGCGA
CAAATTC<u>CTG</u>TTTCATGTGCCGATTACCCTGAATTATCAGGCAGCAAATA
GCCCGAGCAAATTTAACCAGCGTGTTAATGCATATCTGAAAGAACATCCA
GAAACGCCGATTATTGGTATTGATCGTGGTGAACGTAACCTGATTTATAT
CACCGTTATTGATAGCACCGGCAAAATCCTGGAACAGCGTAGCCTGAATA
CCATTCAGCAGTTTGATTACCAGAAAAAACTGGATAATCGCGAGAAAGAA
CGTGTTGCAGCACGTCAGGCATGGTCAGTTGTTGGTACAATTAAAGACCT
GAAACAGGGTTATCTGAGCCAGGTTATTCATGAAATTGTGGATCTGATGA
TTCACTATCAGGCCGTTGTTGTGCTGGAAAACCTGAATTTTGGCTTTAAA
AGCAAACGTACCGGCATTGCAGAAAAAGCAGTTTATCAGCAGTTCGAGAA
AATGCTGATTGACAAACTGAATTGCCTGGTGCTGAAAGATTATCCGGCTG
AAAAAGTTGGTGGTGTTCTGAATCCGTATCAGCTGACCGATCAGTTTACC
AGCTTTGCAAAAATGGGCACCCAGAGCGGATTTCTGTTTTATGTTCCGGC
ACCGTATACGAGCAAAATTGATCCGCTGACCGGTTTTGTTGATCCGTTTG
TTTGGAAAACCATCAAAAACCATGAAAGCCGCAAACATTTTCTGGAAGGT
TTCGATTTTCTGCATTACGACGTTAAAACGGGTGATTTCATCCTGCACTT
TAAAATGAATCGCAATCTGAGTTTTCAGCGTGGCCTGCCTGGTTTTATGC
CTGCATGGGATATTGTGTTTGAGAAAAACGAAACACAGTTCGATGCAAAA
GGCACCCCGTTTATTGCAGGTAAACGTATTGTTCCGGTGATTGAAAATCA
TCGTTTCACCGGTCGTTATCGCGATCTGTATCCGGCAAATGAACTGATCG
CACTGCTGGAAGAAAAGGTATTGTTTTTCGTGATGGCTCAAACATTCTG
CCGAAACTGCTGGAAAATGATGATAGCCATGCAATTGATACCATGGTTGC
ACTGATTCGTAGCGTTCTGCAGATGCGTAATAGCAATGCAGCAACCGGTG
AAGATTACATTAATAGTCCGGTTCGTGATCTGAATGGTGTTTGTTTTGAT
AGCCGTTTTCAGAATCCGGAATGGCCGATGGATGCAGATGCAAATGGTGC
ATATCATATTGCACTGAAAGGACAGCTGCTGCTGAACCACCTGAAAGAAA
GCAAAGATCTGAAACTGCAAAACGGCATTAGCAATCAGGATTGGCTGGCA
TATATCCAAGAACTGCGTAAC<u>GGTCGTAGCAGTGATGATGAAGCAACCGC
AGATAGCCAGCATGCAGCACCGCCTAAAAAGAAACGTAAAGTTGGTGGTA</u>

```
GCGGTGGTTCAGGTGGTAGTGGCGGTAGTGGTGGCTCAGGGGGTTCTGGT

GGCTCTGGTGGTAGCctcgagcaccaccaccaccaccac
```

The bolded and underlined sequences refer to mutant codons introduced into the Cas12a open reading frame. The underlined sequences refer to nucleotides encoding amino acid linker sequences. The double-underlined sequences refer to nucleotides encoding nuclear localization sequences (NLS linker). The italicized sequences refer to nucleotides encoding amino acid affinity tag sequences ((HIS)$_6$).

```
                                              SEQ ID NO.: 490
Human optimized DNA WT Cas12a with NLS linkers
atgACCCAGTTTGAAGGTTTCACCAATCTGTATCAGGTTAGCAAAACCCT

GCGTTTTGAACTGATTCCGCAGGGTAAAACCCTGAAACATATTCAAGAAC

AGGGCTTCATCGAAGAGGATAAAGCACGTAACGATCACTACAAAGAACTG

AAACCGATTATCGACCGCATCTATAAAACCTATGCAGATCAGTGTCTGCA

GCTGGTTCAGCTGGATTGGGAAAATCTGAGCGCAGCAATTGATAGTTATC

GCAAAGAAAAAACCGAAGAAACCCGTAATGCACTGATTGAAGAACAGGCA

ACCTATCGTAATGCCATCCATGATTATTTCATTGGTCGTACCGATAATCT

GACCGATGCAATTAACAAACGTCACGCCGAAATCTATAAAGGCCTGTTTA

AAGCCGAACTGTTTAATGGCAAAGTTCTGAAACAGCTGGGCACCGTTACC

ACCACCGAACATGAAAATGCACTGCTGCGTAGCTTTGATAAATTCACCAC

CTATTTCAGCGGCTTTTATGAGAATCGCAAAAACGTGTTTAGCGCAGAAG

ATATTAGCACCGCAATTCCGCATCGTATTGTGCAGGATAATTTCCCGAAA

TTCAAAGAGAACTGCCACATTTTTACCCGTCTGATTACCGCAGTTCCGAG

CCTGCGTGAACATTTTGAAAACGTTAAAAAAGCCATCGGCATCTTTGTTA

GCACCAGCATTGAAGAAGTTTTTAGCTTCCCGTTTTACAATCAGCTGCTG

ACCCAGACCCAGATTGATCTGTATAACCAACTGCTGGGTGGTATTAGCCG

TGAAGCAGGCACCGAAAAAATCAAAGGTCTGAATGAAGTGCTGAATCTGG

CCATTCAGAAAAATGATGAAACCGCACATATTATTGCAAGCCTGCCGCAT

CGTTTTATTCCGCTGTTCAAACAAATTCTGAGCGATCGTAATACCCTGAG

CTTTATTCTGGAAGAATTCAAATCCGATGAAGAGGTGATTCAGAGCTTTT

GCAAATACAAAACGCTGCTGCGCAATGAAAATGTTCTGGAAACTGCCGAA

GCACTGTTTAACGAACTGAATAGCATTGATCTGACCCACATCTTTATCAG

CCACAAAAAACTGGAAACCATTTCAAGCGCACTGTGTGATCATTGGGATA

CCCTGCGTAATGCCCTGTATGAACGTCGTATTAGCGAACTGACCGGTAAA

ATTACCAAAAGCGCGAAAGAAAAGTTCAGCGCAGTCTGAAACATGAGGA

TATTAATCTGCAAGAGATTATTAGCGCAGCCGGTAAAGAACTGTCAGAAG

CATTTAAACAGAAACCAGCGAATTCTGTCACATGCACATGCAGCACTG

GATCAGCCGCTGCCGACCACCCTGAAAAAACAAGAAGAAAAAGAAATCCT

GAAAAGCCAGCTGGATAGCCTGCTGGGTCTGTATCATCTGCTGGACTGGT

TTGCAGTTGATGAAAGCAATGAAGTTGATCCGGAATTTAGCGCACGTCTG

ACCGGCATTAAACTGGAAATGGAACCGAGCCTGAGCTTTTATAACAAAGC

CCGTAATTATGCCACCAAAAAACCGTATAGCGTCGAAAAATTCAAACTGA

ACTTTCAGATGCCGACCCTGGCAAGCGGTTGGGATGTTAATAAAGAAAAA

AACAACGGTGCCATCCTGTTCGTGAAAAATGGCCTGTATTATCTGGGTAT

TATGCCGAAACAGAAAGGTCGTTATAAAGCGCTGAGCTTTGAACCGACGG

AAAAAACCAGTGAAGGTTTTGATAAAATGTACTACGACTATTTTCCGGAT

GCAGCCAAAATGATTCCGAAATGTAGCACCCAGCTGAAAGCAGTTACCGC

ACATTTTCAGACCCATACCACCCCGATTCTGCTGAGCAATAACTTTATTG

AACCGCTGGAAATCACCAAAGAGATCTACGATCTGAATAACCCGGAAAAA

GAGCCGAAAAAATTCCAGACCGCATATGCAAAAAAAACCGGTGATCAGAA

AGGTTATCGTGAAGCGCTGTGTAAATGGATTGATTTCACCCGTGATTTTC

TGAGCAAATACACCAAAACCACCAGTATCGATCTGAGCAGCCTGCGTCCG

AGCAGCCAGTATAAAGATCTGGGCGAATATTATGCAGAACTGAATCCGCT

GCTGTATCATATTAGCTTTCAGCGTATTGCCGAGAAAGAAATCATGGACG

CAGTTGAAACCGGTAAACTGTACCTGTTCCAGATCTACAATAAAGATTTT

GCCAAAGGCCATCATGGCAAACCGAATCTGCATACCCTGTATTGGACCGG

TCTGTTTAGCCCTGAAAATCTGGCAAAAACCTCGATTAAACTGAATGGTC

AGGCGGAACTGTTTTATCGTCCGAAAAGCCGTATGAAACGTATGGCACAT

CGTCTGGGTGAAAAAATGCTGAACAAAAAACTGAAAGACCAGAAAACCCC

GATCCCGGATACACTGTATCAAGAACTGTATGATTATGTGAACCATCGTC

TGAGCCATGATCTGAGTGATGAAGCACGTGCCCTGCTGCCGAATGTTATT

ACCAAAGAAGTTAGCCACGAGATCATTAAAGATCGTCGTTTTACCAGCGA

CAAATTCTTTTTTCATGTGCCGATTACCCTGAATTATCAGGCAGCAAATA

GCCCGAGCAAATTTAACCAGCGTGTTAATGCATATCTGAAAGAACATCCA

GAAACGCCGATTATTGGTATTGATCGTGGTGAACGTAACCTGATTTATAT

CACCGTTATTGATAGCACCGGCAAAATCCTGGAACAGCGTAGCCTGAATA

CCATTCAGCAGTTTGATTACCAGAAAAAACTGGATAATCGCGAGAAAGAA

CGTGTTGCAGCACGTCAGGCATGGTCAGTTGTTGGTACAATTAAAGACCT

GAAACAGGGTTATCTGAGCCAGGTTATTCATGAAATTGTGGATCTGATGA

TTCACTATCAGGCCGTTGTTGTGCTGGAAAACCTGAATTTTGGCTTTAAA

AGCAAACGTACCGGCATTGCAGAAAAAGCAGTTTATCAGCAGTTCGAGAA

AATGCTGATTGACAAACTGAATTGCCTGGTGCTGAAAGATTATCCGGCTG

AAAAAGTTGGTGGTGTTCTGAATCCGTATCAGCTGACCGATCAGTTTACC

AGCTTTGCAAAAATGGGCACCCAGAGCGGATTTCTGTTTTATGTTCCGGC

ACCGTATACGAGCAAAATTGATCCGCTGACCGGTTTTGTTGATCCGTTTG

TTTGGAAAACCATCAAAAACCATGAAAGCCGCAAACATTTTCTGGAAGGT

TTCGATTTTCTGCATTACGACGTTAAAACGGGTGATTTCATCCTGCACTT

TAAAATGAATCGCAATCTGAGTTTTCAGCGTGGCCTGCCTGGTTTTATGC

CTGCATGGGATATTGTGTTTGAGAAAAACGAAACACAGTTCGATGCAAAA

GGCACCCCGTTTATTGCAGGTAAACGTATTGTTCCGGTGATTGAAAATCA

TCGTTTCACCGGTCGTTATCGCGATCTGTATCCGGCAAATGAACTGATCG

CACTGCTGGAAGAGAAAGGTATTGTTTTTCGTGATGGCTCAAACATTCTG
```

-continued

CCGAAACTGCTGGAAAATGATGATAGCCATGCAATTGATACCATGGTTGC

ACTGATTCGTAGCGTTCTGCAGATGCGTAATAGCAATGCAGCAACCGGTG

AAGATTACATTAATAGTCCGGTTCGTGATCTGAATGGTGTTTGTTTTGAT

AGCCGTTTTCAGAATCCGGAATGGCCGATGGATGCAGATGCAAATGGTGC

ATATCATATTGCACTGAAAGGACAGCTGCTGCTGAACCACCTGAAAGAAA

GCAAAGATCTGAAACTGCAAAACGGCATTAGCAATCAGGATTGGCTGGCA

TATATCCAAGAACTGCGTAAC<u>GGTCGTAGCAGTGATGATGAAGCAACCGC</u>

<u>AGATAGCCAGCATGCAGCACCGCCTAAAAAGAAACGTAAAGTTGGTGGTA</u>

<u>GCGGTGGTTCAGGTGGTAGTGGCGGTAGTGGTGGCTCAGGGGGTTCTGGT</u>

<u>GGCTCTGGTGGTAGC</u>ctcgag*caccaccaccaccaccac*

The underlined sequences refer to nucleotides encoding amino acid linker sequences. The double-underlined sequences refer to nucleotides encoding nuclear localization sequences (NLS linker). The italicized sequences refer to nucleotides encoding amino acid affinity tag sequences ((HIS)$_6$).

SEQ ID NO.: 491
Human optimized DNA M537R F870L Cas12a with
NLS linkers
atgACCCAGTTTGAAGGTTTCACCAATCTGTATCAGGTTAGCAAAACCCT

GCGTTTTGAACTGATTCCGCAGGGTAAAACCCTGAAACATATTCAAGAAC

AGGGCTTCATCGAAGAGGATAAAGCACGTAACGATCACTACAAAGAACTG

AAACCGATTATCGACCGCATCTATAAAACCTATGCAGATCAGTGTCTGCA

GCTGGTTCAGCTGGATTGGGAAAATCTGAGCGCAGCAATTGATAGTTATC

GCAAAGAAAAACCGAAGAAACCCGTAATGCACTGATTGAAGAACAGGCA

ACCTATCGTAATGCCATCCATGATTATTTCATTGGTCGTACCGATAATCT

GACCGATGCAATTAACAAACGTCACGCCGAAATCTATAAAGGCCTGTTTA

AAGCCGAACTGTTTAATGGCAAAGTTCTGAAACAGCTGGGCACCGTTACC

ACCACCGAACATGAAAATGCACTGCTGCGTAGCTTTGATAAATTCACCAC

CTATTTCAGCGGCTTTTATGAGAATCGCAAAAACGTGTTTAGCGCAGAAG

ATATTAGCACCGCAATTCCGCATCGTATTGTGCAGGATAATTTCCCGAAA

TTCAAAGAGAACTGCCACATTTTTACCCGTCTGATTACCGCAGTTCCGAG

CCTGCGTGAACATTTTGAAAACGTTAAAAAAGCCATCGGCATCTTTGTTA

GCACCAGCATTGAAGAAGTTTTTAGCTTCCCGTTTTACAATCAGCTGCTG

ACCCAGACCCAGATTGATCTGTATAACCAACTGCTGGGTGGTATTAGCCG

TGAAGCAGGCACCGAAAAAATCAAAGGTCTGAATGAAGTGCTGAATCTGG

CCATTCAGAAAAATGATGAAACCGCACATATTATTGCAAGCCTGCCGCAT

CGTTTTATTCCGCTGTTCAAACAAATTCTGAGCGATCGTAATACCCTGAG

CTTTATTCTGGAAGAATTCAAATCCGATGAAGAGGTGATTCAGAGCTTTT

GCAAATACAAAACGCTGCTGCGCAATGAAAATGTTCTGGAAACTGCCGAA

GCACTGTTTAACGAACTGAATAGCATTGATCTGACCCACATCTTTATCAG

CCACAAAAAACTGGAAACCATTTCAAGCGCACTGTGTGATCATTGGGATA

CCCTGCGTAATGCCCTGTATGAACGTCGTATTAGCGAACTGACCGGTAAA

ATTACCAAAAGCGCGAAAGAAAAAGTTCAGCGCAGTCTGAAACATGAGGA

TATTAATCTGCAAGAGATTATTAGCGCAGCCGGTAAAGAACTGTCAGAAG

CATTTAAACAGAAAACCAGCGAAATTCTGTCACATGCACATGCAGCACTG

GATCAGCCGCTGCCGACCACCCTGAAAAAACAAGAAGAAAAAGAAATCCT

GAAAAGCCAGCTGGATAGCCTGCTGGGTCTGTATCATCTGCTGGACTGGT

TTGCAGTTGATGAAAGCAATGAAGTTGATCCGGAATTTAGCGCACGTCTG

ACCGGCATTAAACTGGAAATGGAACCGAGCCTGAGCTTTTATAACAAAGC

CCGTAATTATGCCACCAAAAAACCGTATAGCGTCGAAAAATTCAAACTGA

ACTTTCAG<b>CGT</b>CCGACCCTGGCAAGCGGTTGGGATGTTAATAAAGAAAA

AACAACGGTGCCATCCTGTTCGTGAAAAATGGCCTGTATTATCTGGGTAT

TATGCCGAAACAGAAAGGTCGTTATAAAGCGCTGAGCTTTGAACCGACGG

AAAAAACCAGTGAAGGTTTTGATAAAATGTACTACGACTATTTTCCGGAT

GCAGCCAAAATGATTCCGAAATGTAGCACCCAGCTGAAAGCAGTTACCGC

ACATTTTCAGACCCATACCACCCCGATTCTGCTGAGCAATAACTTTATTG

AACCGCTGGAAATCACCAAAGAGATCTACGATCTGAATAACCCGGAAAAA

GAGCCGAAAAAATTCCAGACCGCATATGCAAAAAAAACCGGTGATCAGAA

AGGTTATCGTGAAGCGCTGTGTAAATGGATTGATTTCACCCGTGATTTTC

TGAGCAAATACACCAAAACCACCAGTATCGATCTGAGCAGCCTGCGTCCG

AGCAGCCAGTATAAAGATCTGGGCGAATATTATGCAGAACTGAATCCGCT

GCTGTATCATATTAGCTTTCAGCGTATTGCCGAGAAAGAAATCATGGACG

CAGTTGAAACCGGTAAACTGTACCTGTTCCAGATCTACAATAAAGATTTT

GCCAAAGGCCATCATGGCAAACCGAATCTGCATACCCTGTATTGGACCGG

TCTGTTTAGCCCTGAAAATCTGGCAAAAACCTCGATTAAACTGAATGGTC

AGGCGGAACTGTTTTATCGTCCGAAAAGCCGTATGAAACGTATGGCACAT

CGTCTGGGTGAAAAATGCTGAACAAAAAACTGAAAGACCAGAAAACCCC

GATCCCGGATACACTGTATCAAGAACTGTATGATTATGTGAACCATCGTC

TGAGCCATGATCTGAGTGATGAAGCACGTGCCCTGCTGCCGAATGTTATT

ACCAAAGAAGTTAGCCACGAGATCATTAAAGATCGTCGTTTTACCAGCGA

CAAATTC<b>CTG</b>TTTCATGTGCCGATTACCCTGAATTATCAGGCAGCAAATA

GCCCGAGCAAATTTAACCAGCGTGTTAATGCATATCTGAAAGAACATCCA

GAAACGCCGATTATTGGTATTGATCGTGGTGAACGTAACCTGATTTATAT

CACCGTTATTGATAGCACCGGCAAAATCCTGGAACAGCGTAGCCTGAATA

CCATTCAGCAGTTTGATTACCAGAAAAAACTGGATAATCGCGAGAAAGAA

CGTGTTGCAGCACGTCAGGCATGGTCAGTTGTTGGTACAATTAAAGACCT

GAAACAGGGTTATCTGAGCCAGGTTATTCATGAAATTGTGGATCTGATGA

TTCACTATCAGGCCGTTGTTGTGCTGGAAAACCTGAATTTTGGCTTTAAA

AGCAAACGTACCGGCATTGCAGAAAAAGCAGTTTATCAGCAGTTCGAGAA

AATGCTGATTGACAAACTGAATTGCCTGGTGCTGAAAGATTATCCGGCTG

AAAAAGTTGGTGGTGTTCTGAATCCGTATCAGCTGACCGATCAGTTTACC

AGCTTTGCAAAAATGGGCACCCAGAGCGGATTTCTGTTTTATGTTCCGGC

ACCGTATACGAGCAAAATTGATCCGCTGACCGGTTTTGTTGATCCGTTTG

```
TTTGGAAAACCATCAAAAACCATGAAAGCCGCAAACATTTTCTGGAAGGT

TTCGATTTTCTGCATTACGACGTTAAAACGGGTGATTTCATCCTGCACTT

TAAAATGAATCGCAATCTGAGTTTTCAGCGTGGCCTGCCTGGTTTTATGC

CTGCATGGGATATTGTGTTTGAGAAAAACGAAACACAGTTCGATGCAAAA

GGCACCCCGTTTATTGCAGGTAAACGTATTGTTCCGGTGATTGAAAATCA

TCGTTTCACCGGTCGTTATCGCGATCTGTATCCGGCAAATGAACTGATCG

CACTGCTGGAAGAGAAAGGTATTGTTTTTCGTGATGGCTCAAACATTCTG

CCGAAACTGCTGGAAAATGATGATAGCCATGCAATTGATACCATGGTTGC

ACTGATTCGTAGCGTTCTGCAGATGCGTAATAGCAATGCAGCAACCGGTG

AAGATTACATTAATAGTCCGGTTCGTGATCTGAATGGTGTTTGTTTTGAT

AGCCGTTTTCAGAATCCGGAATGGCCGATGGATGCAGATGCAAATGGTGC

ATATCATATTGCACTGAAAGGACAGCTGCTGCTGAACCACCTGAAAGAAA

GCAAAGATCTGAAACTGCAAAACGGCATTAGCAATCAGGATTGGCTGGCA

TATATCCAAGAACTGCGTAACGGTCGTAGCAGTGATGATGAAGCAACCGC

AGATAGCCAGCATGCAGCACCGCCTAAAAAGAAACGTAAAGTTGGTGGTA

GCGGTGGTTCAGGTGGTAGTGGCGGTAGTGGTGGCTCAGGGGGTTCTGGT

GGCTCTGGTGGTAGCctcgagcaccaccaccaccaccac
```

The bolded and underlined sequences refer to mutant codons introduced into the Cas12a open reading frame. The underlined sequences refer to nucleotides encoding amino acid linker sequences. The double-underlined sequences refer to nucleotides encoding nuclear localization sequences (NLS linker). The italicized sequences refer to nucleotides encoding amino acid affinity tag sequences ((HIS)₆).

SEQ ID NO.: 492
WT Cas12a AA with NLS linkers
MTQFEGFTNLYQVSKTLRFELIPQGKTLKHIQEQGFIEEDKARNDHYKEL

KPIIDRIYKTYADQCLQLVQLDWENLSAAIDSYRKEKTEETRNALIEEQA

TYRNAIHDYFIGRTDNLTDAINKRHAEIYKGLFKAELFNGKVLKQLGTVT

TTEHENALLRSFDKFTTYFSGFYENRKNVFSAEDISTAIPHRIVQDNFPK

FKENCHIFTRLITAVPSLREHFENVKKAIGIFVSTSIEEVFSFPFYNQLL

TQTQIDLYNQLLGGISREAGTEKIKGLNEVLNLAIQKNDETAHIIASLPH

RFIPLFKQILSDRNTLSFILEEFKSDEEVIQSFCKYKTLLRNENVLETAE

ALFNELNSIDLTHIFISHKKLETISSALCDHWDTLRNALYERRISELTGK

ITKSAKEKVQRSLKHEDINLQEIISAAGKELSEAFKQKTSEILSHAHAAL

DQPLPTTLKKQEEKEILKSQLDSLLGLYHLLDWFAVDESNEVDPEFSARL

TGIKLEMEPSLSFYNKARNYATKKPYSVEKFKLNFQMPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYAKKTGDQKGYREALCKWIDFTRDFLSKYTKTTSIDLSSLRP

SSQYKDLGEYYAELNPLLYHISFQRIAEKEIMDAVETGKLYLFQIYNKDF

AKGHHGKPNLHTLYWTGLFSPENLAKTSIKLNGQAELFYRPKSRMKRMAH

RLGEKMLNKKLKDQKTPIPDTLYQELYDYVNHRLSHDLSDEARALLPNVI

TKEVSHEIIKDRRFTSDKFFFHVPITLNYQAANSPSKFNQRVNAYLKEHP

ETPIIGIDRGERNLIYITVIDSTGKILEQRSLNTIQQFDYQKKLDNREKE

RVAARQAWSVVGTIKDLKQGYLSQVIHEIVDLMIHYQAVVVLENLNFGFK

SKRTGIAEKAVYQQFEKMLIDKLNCLVLKDYPAEKVGGVLNPYQLTDQFT

SFAKMGTQSGFLFYVPAPYTSKIDPLTGFVDPFVWKTIKNHESRKHFLEG

FDFLHYDVKTGDFILHFKMNRNLSFQRGLPGFMPAWDIVFEKNETQFDAK

GTPFIAGKRIVPVIENHRFTGRYRDLYPANELIALLEEKGIVFRDGSNIL

PKLLENDDSHAIDTMVALIRSVLQMRNSNAATGEDYINSPVRDLNGVCFD

SRFQNPEWPMDADANGAYHIALKGQLLLNHLKESKDLKLQNGISNQDWLA

YIQELRNG*RSSDDEATADSQHAAPPKKKRKVGGSGGSGGSGGSGGSGGSG*

*GSGGSLEHHHHHH*

The underlined sequences refer to amino acid sequences encoding amino acid linker sequences. The double-underlined sequences refer to amino acid sequences encoding nuclear localization sequences (NLS linker). The italicized sequences refer to amino acid sequences encoding amino acid affinity tag sequences ((HIS)₆).

SEQ ID NO.: 493
M537R F870L Cas12a AA with NLS linkers
MTQFEGFTNLYQVSKTLRFELIPQGKTLKHIQEQGFIEEDKARNDHYKEL

KPIIDRIYKTYADQCLQLVQLDWENLSAAIDSYRKEKTEETRNALIEEQA

TYRNAIHDYFIGRTDNLTDAINKRHAEIYKGLFKAELFNGKVLKQLGTVT

TTEHENALLRSFDKFTTYFSGFYENRKNVFSAEDISTAIPHRIVQDNFPK

FKENCHIFTRLITAVPSLREHFENVKKAIGIFVSTSIEEVFSFPFYNQLL

TQTQIDLYNQLLGGISREAGTEKIKGLNEVLNLAIQKNDETAHIIASLPH

RFIPLFKQILSDRNTLSFILEEFKSDEEVIQSFCKYKTLLRNENVLETAE

ALFNELNSIDLTHIFISHKKLETISSALCDHWDTLRNALYERRISELTGK

ITKSAKEKVQRSLKHEDINLQEIISAAGKELSEAFKQKTSEILSHAHAAL

DQPLPTTLKKQEEKEILKSQLDSLLGLYHLLDWFAVDESNEVDPEFSARL

TGIKLEMEPSLSFYNKARNYATKKPYSVEKFKLNFQRPTLASGWDVNKEK

NNGAILFVKNGLYYLGIMPKQKGRYKALSFEPTEKTSEGFDKMYYDYFPD

AAKMIPKCSTQLKAVTAHFQTHTTPILLSNNFIEPLEITKEIYDLNNPEK

EPKKFQTAYAKKTGDQKGYREALCKWIDFTRDFLSKYTKTTSIDLSSLRP

SSQYKDLGEYYAELNPLLYHISFQRIAEKEIMDAVETGKLYLFQIYNKDF

AKGHHGKPNLHTLYWTGLFSPENLAKTSIKLNGQAELFYRPKSRMKRMAH

RLGEKMLNKKLKDQKTPIPDTLYQELYDYVNHRLSHDLSDEARALLPNVI

TKEVSHEIIKDRRFTSDKFLFHVPITLNYQAANSPSKFNQRVNAYLKEHP

ETPIIGIDRGERNLIYITVIDSTGKILEQRSLNTIQQFDYQKKLDNREKE

RVAARQAWSVVGTIKDLKQGYLSQVIHEIVDLMIHYQAVVVLENLNFGFK

SKRTGIAEKAVYQQFEKMLIDKLNCLVLKDYPAEKVGGVLNPYQLTDQFT

SFAKMGTQSGFLFYVPAPYTSKIDPLTGFVDPFVWKTIKNHESRKHFLEG

FDFLHYDVKTGDFILHFKMNRNLSFQRGLPGFMPAWDIVFEKNETQFDAK

-continued

```
GTPFIAGKRIVPVIENHRFTGRYRDLYPANELIALLEEKGIVFRDGSNIL

PKLLENDDSHAIDTMVALIRSVLQMRNSNAATGEDYINSPVRDLNGVCFD

SRFQNPEWPMDADANGAYHIALKGQLLLNHLKESKDLKLQNGISNQDWLA

YIQELRNGRSSDDEATADSQHAAPPKKKRKVGGSGGSGGSGGSGGSGGSG

GSGGSLEHHHHHH
```

The bolded and underlined sequences refer to mutant amino acids introduced into the Cas12a polypeptide variant. The underlined sequences refer to amino acid sequences encoding amino acid linker sequences. The double-underlined sequences refer to amino acid sequences encoding nuclear localization sequences (NLS linker). The italicized sequences refer to amino acid sequences encoding amino acid affinity tag sequences (($HIS$)$_6$).

REFERENCES

Chen, J. S., et al., *Enhanced proofreading governs CRISPR-Cas9 targeting accuracy*. Nature, 2017. 550(7676): p. 407-410.

Gao, L., et al., *Engineered Cpf1 variants with altered PAM specificities increase genome targeting range*. Nat Biotechnol. 2017; 35(8): 789-792.

Jinek M, et al. *A programmable dual-RNA-guided DNA endonuclease in adaptive bacterial immunity*. Science. 2012; 337:816-821. doi: 10.1126/science.1225829.

Kleinstiver, B. P., et al., *High-fidelity CRISPR-Cas9 nucleases with no detectable genome-wide off-target effects*. Nature, 2016. 529(7587): p. 490-5.

Slaymaker, I. M., et al., *Rationally engineered Cas9 nucleases with improved specificity*. Science, 2016. 351 (6268): p. 84-8.

Sun, Y., et al., *Factors influencing the nuclear targeting ability of nuclear localization signals*. J Drug Target, 2016. 24(10): p. 927-933.

Wrenbeck E E, Klesmith J R, Stapleton J A, Adeniran A, Tyo K E, Whitehead T A. Plasmid-based one-pot saturation mutagenesis. *Nat Methods.* 2016; 13(11):928-930. doi: 10.1038/nmeth.4029

Zetsche, B., et al., *Cpf1 Is a Single RNA-Guided Endonuclease of a Class 2 CRISPR-Cas System*. Cell. 2015; 163:759-771. doi: 10.1016/j.cell.2015.09.038.

INCORPORATION BY REFERENCE

All of the patents, patent applications, patent application publications, and other publications cited herein are hereby incorporated by reference as if set forth in their entirety.

Preferred Embodiments

The present invention has been described in connection with what are presently considered to be the most practical and preferred embodiments. However, the invention has been presented by way of illustration and is not intended to be limited to the disclosed embodiments. Accordingly, one of skill in the art will realize that the invention is intended to encompass all modifications and alternative arrangements within the spirit and scope of the invention as set forth in the appended claims.

SEQUENCE LISTING (495 sequences)

SEQ ID NO: 1 - RNA, 41 nt, Artificial Sequence
  SYNTHETIC
uaauuucuacucuuguagauuaaugcccuguagucucucug

SEQ ID NO: 2 - RNA, 41 nt, Artificial Sequence
  SYNTHETIC
uaauuucuacucuuguagauuaauuaacagcuugcugguga

SEQ ID NO: 3 - DNA, 27 bp, Artificial Sequence
  SYNTHETIC
aagaatgttgtgataaaaggtgatgct

SEQ ID NO: 4 - DNA, 24 bp, Artificial Sequence
  SYNTHETIC
gaggcagaagtcccatggatgtgt

SEQ ID NO: 5 - DNA, 4155 bp, Artificial Sequence
  SYNTHETIC
atgggcagcagcagcagcggcctggtgccgcgcggcagccatatggctagcatgactggtggacagcaaatgggtcgggatccaggtaaaccgattccgaatccgctgctgggtctggatagcaccgcaccgaaaaaaaaacgtaaagttggtattcatggtgttccggcagcaacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaaccctaaaaaaaaacgcaaagtgaagcttgcggccgcactcgagcaccaccaccaccaccactga

SEQ ID NO: 6 - DNA, 4113 bp, Artificial Sequence
  SYNTHETIC
atgggcagcagcagcagcggcctggtgccgcgcggcagccatatggctagcatgactggtggacagcaaatgggtcgggatccagcaccgaaaaaaaaacgtaaagttggtattcatggtgttccggcagcaacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaaccctaaaaaaaaacgcaaagtgaagcttgcggccgcactcgagcaccaccaccaccaccactga

SEQ ID NO: 7 - DNA, 4014 bp, Artificial Sequence
  SYNTHETIC
atgccgaaaaaaaaacgcaaagtgggtattcatggtgttccggcagcaacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacccgaaaaaaaaacgcaaagtgctcgagcaccaccaccaccaccactga

SEQ ID NO: 8 - DNA, 3969 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacccgaaaaaaaaacgcaaagtgctcgagcaccaccaccaccaccactga

SEQ ID NO: 9 - DNA, 4191 bp, Artificial Sequence
  SYNTHETIC
atgggcagcagccatcatcatcatcatcacagcagcggcctggtgccgcgcggcagccatatggctagcatgactggtggacagcaaatgggtcgggatccaacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccactga

SEQ ID NO: 10 - DNA, 4092 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccactga

SEQ ID NO: 11 - DNA, 4173 bp, Artificial Sequence
  SYNTHETIC
atgggcagcagcagcagcggcctggtgccgcgcggcagccatatggctagcatgactggtggacagcaaatgggtcgggatccaacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccactga

SEQ ID NO: 12 - DNA, 4143 bp, Artificial Sequence
  SYNTHETIC
atgccgcctccgaaacgtccgcgtctggatggtatccacggagtcccagcagccacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccactga

SEQ ID NO: 13 - DNA, 4182 bp, Artificial Sequence
  SYNTHETIC
atgagcagtgatgatgaagcaaccgcagatagccagcatgcagcaccgcctaaaaagaaacgtaaagttggtatccacggagtcccagcagccacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccactga

SEQ ID NO: 14 - DNA, 4074 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtaaacgtccggcagcaaccaaaaaagcaggtcaggcaaaaaagaaaaaaggtggtagcggtggttcaggtggtagtggcggtagtggtggctcagggggttctggtggctctggtggtagcctcgagcaccaccaccaccaccactga

SEQ ID NO: 15 - DNA, 4083 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtaaacgtaccgcagatggtagcgaatttgaaagcccgaaaaaaaagcgtaaggtggaaggtggtagcggtggttcaggtggtagtggcggtagtggtggctcagggggttctggtggctctggtggtagcctcgagcaccaccaccaccaccactga

SEQ ID NO: 16 - DNA, 4167 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggcggtagtaaacgtaccgcagatggtagcgaatttgaaagcccgaaaaaaaagcgtaaggtggaaggtggtagcggtggttcaggtggtagtggcggtagtggtggctcagggggttctggtggctctggtggtagcctcgagcaccaccaccaccaccactga

SEQ ID NO: 17 - DNA, 4149 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtaaacgtccggcagcaaccaaaaaagcaggtcaggcaaaaaagaaaaaaggtggtagcggcggtagtaaacgtaccgcagatggtagcgaatttgaaagcccgaaaaaaaagcgtaaggtggaaggtggtagcggtggttcaggtggtagtggcggtagtggtggctcagggggttctggtggctctggtggtagcctcgagcaccaccaccaccaccactga

SEQ ID NO: 18 - protein, 1384 aa, Artificial Sequence
  SYNTHETIC
MGSSSSGLVPRGSHMASMTGGQQMGRDPGKPIPNPLLGLDSTAPKKKRKVGIHGVPAATQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNPKKKRKVKLAAALEHHHHHH

SEQ ID NO: 19 - protein, 1370 aa, Artificial Sequence
  SYNTHETIC
MGSSSSGLVPRGSHMASMTGGQQMGRDPAPKKKRKVGIHGVPAATQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNPKKKRKVKLAAALEHHHHHH

SEQ ID NO: 20 - protein, 1337 aa, Artificial Sequence
  SYNTHETIC
MPKKKRKVGIHGVPAATQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNPKKKRKVLEHHHHHH

SEQ ID NO: 21 - protein, 1322 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNPKKKRKVLEHHHHHH

SEQ ID NO: 22 - protein, 1396 aa, Artificial Sequence
  SYNTHETIC
MGSSHHHHHHSSGLVPRGSHMASMTGGQQMGRDPTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSGGSGGSGGSGGSGGSGGSLEHHHHHH

SEQ ID NO: 23 - protein, 1363 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSGGSGGSGGSGGSGGSGGSLEHHHHHH

SEQ ID NO: 24 - protein, 1390 aa, Artificial Sequence
  SYNTHETIC
MGSSSSGLVPRGSHMASMTGGQQMGRDPTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSGGSGGSGGSGGSGGSGGSLEHHHHHH

SEQ ID NO: 25 - protein, 1380 aa, Artificial Sequence
  SYNTHETIC
MPPPKRPRLDGIHGVPAATQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSGGSGGSGGSGGSGGSGGSLEHHHHHH

SEQ ID NO: 26 - protein, 1393 aa, Artificial Sequence
  SYNTHETIC
MSSDDEATADSQHAAPPKKKRKVGIHGVPAATQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSGGSGGSGGSGGSGGSGGSLEHHHHHH

SEQ ID NO: 27 - protein, 1357 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRKRPAATKKAGQAKKKKGGSGGSGGSGGSGGSGGSGGSGGSLEHHHHHH

SEQ ID NO: 28 - protein, 1360 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRKRTADGSEFESPKKKRKVEGGSGGSGGSGGSGGSGGSGGSGGSLEHHHHHH

SEQ ID NO: 29 - protein, 1388 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSKRTADGSEFESPKKKRKVEGGSGGSGGSGGSGGSGGSGGSGGSLEHHHHHH

SEQ ID NO: 30 - protein, 1382 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRKRPAATKKAGQAKKKKGGSGGSKRTADGSEFESPKKKRKVEGGSGGSGGSGGSGGSGGSGGSGGSLEHHHHHH

SEQ ID NO: 31 - DNA, 25 bp, Artificial Sequence
  SYNTHETIC
ttttacataaaactcttttaggtta

SEQ ID NO: 32 - DNA, 25 bp, Artificial Sequence
  SYNTHETIC
tttcacataaaactcttttaggtta

SEQ ID NO: 33 - DNA, 25 bp, Artificial Sequence
  SYNTHETIC
ttttcccctccctggcttttattat

SEQ ID NO: 34 - DNA, 25 bp, Artificial Sequence
  SYNTHETIC
tttcccctccctggcttttattatt

SEQ ID NO: 35 - DNA, 25 bp, Artificial Sequence
  SYNTHETIC
ttttattattacaactctgtgcttt

SEQ ID NO: 36 - DNA, 25 bp, Artificial Sequence
  SYNTHETIC
tttattattacaactctgtgctttt

SEQ ID NO: 37 - DNA, 25 bp, Artificial Sequence
  SYNTHETIC
tttttcatcaccatcctgaatatct

SEQ ID NO: 38 - DNA, 25 bp, Artificial Sequence
  SYNTHETIC
ttttcatcaccatcctgaatatcta

SEQ ID NO: 39 - DNA, 25 bp, Artificial Sequence
  SYNTHETIC
tttcatcaccatcctgaatatctat

SEQ ID NO: 40 - DNA, 25 bp, Artificial Sequence
  SYNTHETIC
tttatactattaataaaaagacatt

SEQ ID NO: 41 - DNA, 25 bp, Artificial Sequence
  SYNTHETIC
tttattaatagtataaatattaatt

SEQ ID NO: 42 - DNA, 25 bp, Artificial Sequence
  SYNTHETIC
ttttattaatagtataaatattaat

SEQ ID NO: 43 - DNA, 25 bp, Artificial Sequence
  SYNTHETIC
tttttattaatagtataaatattaa

SEQ ID NO: 44 - DNA, 25 bp, Artificial Sequence
  SYNTHETIC
tttttggtaaggaggagttttcact

SEQ ID NO: 45 - DNA, 25 bp, Artificial Sequence
  SYNTHETIC
ttttggtaaggaggagttttcactg

SEQ ID NO: 46 - DNA, 25 bp, Artificial Sequence
  SYNTHETIC
tttggtaaggaggagttttcactga

SEQ ID NO: 47 - DNA, 25 bp, Artificial Sequence
  SYNTHETIC
ttttcactgaagttcagcagtgatg

SEQ ID NO: 48 - DNA, 25 bp, Artificial Sequence
  SYNTHETIC
tttcactgaagttcagcagtgatgg

SEQ ID NO: 49 - DNA, 25 bp, Artificial Sequence
  SYNTHETIC
tttcactaacctggtaaaagaggat

SEQ ID NO: 50 - DNA, 25 bp, Artificial Sequence
  SYNTHETIC
tttaccaggttagtgaaacgcagac

SEQ ID NO: 51 - DNA, 25 bp, Artificial Sequence
  SYNTHETIC
ttttaccaggttagtgaaacgcaga

SEQ ID NO: 52 - DNA, 25 bp, Artificial Sequence
  SYNTHETIC
ttttttttgtgggtgtaatagtgac

SEQ ID NO: 53 - DNA, 25 bp, Artificial Sequence
  SYNTHETIC
tttttttgtgggtgtaatagtgaca

SEQ ID NO: 54 - DNA, 25 bp, Artificial Sequence
  SYNTHETIC
ttttttgtgggtgtaatagtgacat

SEQ ID NO: 55 - DNA, 25 bp, Artificial Sequence
  SYNTHETIC
tttttgtgggtgtaatagtgacatt

SEQ ID NO: 56 - DNA, 25 bp, Artificial Sequence
  SYNTHETIC
ttttgtgggtgtaatagtgacattt

SEQ ID NO: 57 - DNA, 23 bp, Artificial Sequence
  SYNTHETIC
tcccactgtacctctgttatcca

SEQ ID NO: 58 - DNA, 23 bp, Artificial Sequence
  SYNTHETIC
tggtcctcgtcatttagcagttt

SEQ ID NO: 59 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSACLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 60 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSALLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 61 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSAKLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 62 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARMTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 63 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLLGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 64 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLMGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 65 - protein, 1307 aa, Artificial Sequence
  SYNTHESIS
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLVGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 66 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTRIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 67 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTEIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 68 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTLIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 69 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTSIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 70 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTWIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 71 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTVIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 72 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKAEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 73 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKREMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 74 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKQEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 75 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKEEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 76 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKGEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 77 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKHEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 78 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKKEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 79 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKSEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 80 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLAMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 81 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLRMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 82 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLNMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 83 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLCMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 84 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLQMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 85 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLGMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 86 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLHMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 87 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLIMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 88 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLLMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 89 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLKMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 90 - protein, 1307 aa, Artificial Sequence
  SYHTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLMMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 91 - protein, 1307 aa, Artificial Sequence
  synthetic
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLSMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 92 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLTMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 93 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLYMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 94 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLVMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 95 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMAPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 96 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMRPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 97 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMQPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 98 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMGPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 99 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMLPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 100 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMKPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 101 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMMPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 102 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMFPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 103 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMSPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 104 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMTPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 105 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMYPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 106 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMVPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 107 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMERSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 108 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEKSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 109 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEMSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 110 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMESSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 111 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEWSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 112 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEYSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 113 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPGLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 114 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPLLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 115 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLRFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 116 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSLYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 117 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSWYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 118 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYAKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 119 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYRKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 120 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYIKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 121 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYLKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 122 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYTKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 123 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYVKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 124 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNRARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 125 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKAKNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 126 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYALKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 127 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYAMKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 128 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYAVKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 129 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATRKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 130 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYDVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 131 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSDEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 132 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSLEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 133 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSMEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 134 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLAMGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 135 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLACGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 136 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKERNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 137 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKDNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 138 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGRILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 139 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGTILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 140 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGVILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 141 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAVLFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 142 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAIMFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 143 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFMKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 144 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVANGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 145 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKAGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 146 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKDGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 147 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKEGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 148 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKMGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 149 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMDKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 150 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKAKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 151 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKPKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 152 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKSKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 153 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKTKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 154 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQEGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 155 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRGKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 156 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRMKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 157 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYCALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 158 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALTFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 159 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALVFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 160 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPIEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 161 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTHKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 162 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTVKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 163 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTERTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 164 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEFTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 165 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYEYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 166 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFGDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 167 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDACKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 168 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQMKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 169 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKRVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 170 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKIVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 171 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVAAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 172 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVRAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 173 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVQAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 174 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVGAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 175 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVYAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 176 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTGHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 177 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHMQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 178 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFATHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 179 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFRTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 180 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFNTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 181 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFLTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 182 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFKTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 183 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQAHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 184 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTGTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 185 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTSTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 186 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTTTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 187 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTVTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 188 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHETPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 189 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHHTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 190 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHLTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 191 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHMTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 192 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHFTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 193 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTPPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 194 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPICLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 195 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILCSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 196 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILWSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 197 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSRNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 198 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFNEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 199 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFMEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 200 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFSEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 201 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFINPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 202 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEALEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 203 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEDLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 204 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEELEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 205 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIETLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 206 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEIGKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 207 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSSEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 208 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDESRALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 209 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARELLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 210 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVIAKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 211 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVIVKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 212 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKVVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 213 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDKRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 214 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTFDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 215 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTTDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 216 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHAPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 217 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLDYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 218 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNRRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 219 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNGRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 220 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQADNSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 221 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQASNSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 222 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAAGSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 223 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAAKSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 224 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANVPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 225 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPLKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 226 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPMKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 227 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPWKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 228 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNCRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 229 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNHRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 230 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNWRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 231 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNRYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 232 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNDYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 233 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNADLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 234 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEAPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 235 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKENPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 236 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDDARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 237 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETTIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 238 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIAIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 239 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIISIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 240 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGADRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 241 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGVDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 242 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGEANLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 243 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGELNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 244 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGESNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 245 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGEVNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 246 - DNA, 39 bp, Artificial Sequence
  SYNTHETIC
  misc_feature (19)..(20): n is a, c, g, or t
gaccccgagttctccgccnnkctgacaggcatcaaactg

SEQ ID NO: 247 - DNA, 38 bp, Artificial Sequence
  SYNTHETIC
  misc_feature (23)..(24): n is a, c, g, or t
ggaccccgagttctccgccagannkacaggcatcaaac

SEQ ID NO: 248 - DNA, 41 bp, Artificial Sequence
  SYNTHETIC
  misc_feature (20)..(21): n is a, c, g, or t
cgagttctccgccagactgnnkggcatcaaactggaaatgg

SEQ ID NO: 249 - DNA, 45 bp, Artificial Sequence
  SYNTHETIC
  misc_feature (22)..(23): n is a, c, g, or t
gagttctccgccagactgacannkatcaaactggaaatggaaccc

SEQ ID NO: 250 - DNA, 41 bp, Artificial Sequence
  SYNTHETIC
  misc_feature (20)..(21): n is a, c, g, or t
ctccgccagactgacaggcnnkaaactggaaatggaaccca

SEQ ID NO: 251 - DNA, 39 bp, Artificial Sequence
  SYNTHETIC
  misc_feature (19)..(20): n is a, c, g, or t
gccagactgacaggcatcnnkctggaaatggaacccagc

SEQ ID NO: 252 - DNA, 43 bp, Artificial Sequence
  SYNTHETIC
  misc_feature (21)..(22): n is a, c, g, or t
ccagactgacaggcatcaaannkgaaatggaacccagcctgtc

SEQ ID NO: 253 - DNA, 43 bp, Artificial Sequence
  SYNTHETIC
  misc_feature (21)..(22): n is a, c, g, or t
gactgacaggcatcaaactgnnkatggaacccagcctgtcctt

SEQ ID NO: 254 - DNA, 45 bp, Artificial Sequence
  SYNTHETIC
  misc_feature (22)..(23): n is a, c, g, or t
ctgacaggcatcaaactggaannkgaacccagcctgtccttctac

SEQ ID NO: 255 - DNA, 42 bp, Artificial Sequence
  SYNTHETIC
  misc_feature (25)..(26): n is a, c, g, or t
ctgacaggcatcaaactggaaatgnnkcccagcctgtccttc

SEQ ID NO: 256 - DNA, 47 bp, Artificial Sequence
  SYNTHETIC
  misc_feature (30)..(31): n is a, c, g, or t
gactgacaggcatcaaactggaaatggaannkagcctgtccttctac

SEQ ID NO: 257 - DNA, 45 bp, Artificial Sequence
  SYNTHETIC
  misc_feature (22)..(23): n is a, c, g, or t
atcaaactggaaatggaacccnnkctgtccttctacaacaaggcc

SEQ ID NO: 258 - DNA, 45 bp, Artificial Sequence
  SYNTHETIC
  misc_feature (22)..(23): n is a, c, g, or t
aaactggaaatggaacccagcnnktccttctacaacaaggccaga

SEQ ID NO: 259 - DNA, 45 bp, Artificial Sequence
  SYNTHETIC
  misc_feature (22)..(23): n is a, c, g, or t
ctggaaatggaacccagcctgnnkttctacaacaaggccagaaac

SEQ ID NO: 260 - DNA, 45 bp, Artificial Sequence
  SYNTHETIC
  misc_feature (22)..(23): n is a, c, g, or t
gaaatggaacccagcctgtccnnktacaacaaggccagaaactac

SEQ ID NO: 261 - DNA, 41 bp, Artificial Sequence
  SYNTHETIC
  misc_feature (20)..(21): n is a, c, g, or t
ggaacccagcctgtccttcnnkaacaaggccagaaactacg

SEQ ID NO: 262 - DNA, 39 bp, Artificial Sequence
  SYNTHETIC
  misc_feature (19)..(20): n is a, c, g, or t
cccagcctgtccttctacnnkaaggccagaaactacgcc

SEQ ID NO: 263 - DNA, 41 bp, Artificial Sequence
  SYNTHETIC
  misc_feature (20)..(21): n is a, c, g, or t
cagcctgtccttctacaacnnkgccagaaactacgccacca

SEQ ID NO: 264 - DNA, 47 bp, Artificial Sequence
  SYNTHETIC
  misc_feature (23)..(24): n is a, c, g, or t
cagcctgtccttctacaacaagnnkagaaactacgccaccaagaaac

SEQ ID NO: 265 - DNA, 45 bp, Artificial Sequence
  SYNTHETIC
  misc_feature (22)..(23): n is a, c, g, or t
ctgtccttctacaacaaggccnnkaactacgccaccaagaaaccc

SEQ ID NO: 266 - DNA, 45 bp, Artificial Sequence
  SYNTHETIC
  misc_feature (22)..(23): n is a, c, g, or t
tccttctacaacaaggccagannktacgccaccaagaaaccctac

SEQ ID NO: 267 - DNA, 45 bp, Artificial Sequence
  SYNTHETIC
  misc_feature (22)..(23): n is a, c, g, or t
ttctacaacaaggccagaaacnnkgccaccaagaaaccctacagc

SEQ ID NO: 268 - DNA, 45 bp, Artificial Sequence
  SYNTHETIC
  misc_feature (22)..(23): n is a, c, g, or t
tacaacaaggccagaaactacnnkaccaagaaaccctacagcgtg

SEQ ID NO: 269 - DNA, 41 bp, Artificial Sequence
  SYNTHETIC
  misc_feature (20)..(21): n is a, c, g, or t
caaggccagaaactacgccnnkaagaaaccctacagcgtgg

SEQ ID NO: 270 - DNA, 41 bp, Artificial Sequence
  SYNTHETIC
  misc_feature (20)..(21): n is a, c, g, or t
ggccagaaactacgccaccnnkaaaccctacagcgtggaaa

SEQ ID NO: 271 - DNA, 43 bp, Artificial Sequence
  SYNTHETIC
  misc_feature (21)..(22): n is a, c, g, or t
ccagaaactacgccaccaagnnkccctacagcgtggaaaagtt

SEQ ID NO: 272 - DNA, 49 bp, Artificial Sequence
  SYNTHETIC
  misc_feature (26)..(27): n is a, c, g, or t
ggccagaaactacgccaccaagaaannktacagcgtggaaaagtttaag

SEQ ID NO: 273 - DNA, 45 bp, Artificial Sequence
  SYNTHETIC
  misc_feature (22)..(23): n is a, c, g, or t
aactacgccaccaagaaacccnnkagcgtggaaaagtttaagctg

SEQ ID NO: 274 - DNA, 48 bp, Artificial Sequence
  SYNTHETIC
  misc_feature (23)..(24): n is a, c, g, or t
ctacgccaccaagaaaccctacnnkgtggaaaagtttaagctgaactt

SEQ ID NO: 275 - DNA, 47 bp, Artificial Sequence
  SYNTHETIC
  misc_feature (23)..(24): n is a, c, g, or t
cgccaccaagaaaccctacagcnnkgaaaagtttaagctgaacttcc

SEQ ID NO: 276 - DNA, 47 bp, Artificial Sequence
  SYNTHETIC
  misc_feature (23)..(24): n is a, c, g, or t
caccaagaaaccctacagcgtgnnkaagtttaagctgaacttccaga

SEQ ID NO: 277 - DNA, 47 bp, Artificial Sequence
  SYNTHETIC
  misc_feature (23)..(24): n is a, c, g, or t
caagaaaccctacagcgtggaannktttaagctgaacttccagatgc

SEQ ID NO: 278 - DNA, 45 bp, Artificial Sequence
  SYNTHETIC
  misc_feature (22)..(23): n is a, c, g, or t
aaaccctacagcgtggaaaagnnkaagctgaacttccagatgccc

SEQ ID NO: 279 - DNA, 44 bp, Artificial Sequence
  SYNTHETIC
  misc_feature (22)..(23): n is a, c, g, or t
ccctacagcgtggaaaagtttnnkctgaacttccagatgcccac

SEQ ID NO: 280 - DNA, 45 bp, Artificial Sequence
  SYNTHETIC
  misc_feature (22)..(23): n is a, c, g, or t
tacagcgtggaaaagtttaagnnkaacttccagatgcccaccctg

SEQ ID NO: 281 - DNA, 43 bp, Artificial Sequence
  SYNTHETIC
  misc_feature (21)..(22): n is a, c, g, or t
gcgtggaaaagtttaagctgnnkttccagatgcccaccctggc

SEQ ID NO: 282 - DNA, 45 bp, Artificial Sequence
  SYNTHETIC
  misc_feature (23)..(24): n is a, c, g, or t
cgtggaaaagtttaagctgaacnnkcagatgcccaccctggccag

SEQ ID NO: 283 - DNA, 44 bp, Artificial Sequence
  SYNTHETIC
  misc_feature (23)..(24): n is a, c, g, or t
ggaaaagtttaagctgaacttcnnkatgcccaccctggccagcg

SEQ ID NO: 284 - DNA, 37 bp, Artificial Sequence
  SYNTHETIC
  misc_feature (18)..(19): n is a, c, g, or t
ttaagctgaacttccagnnkcccaccctggccagcgg

SEQ ID NO: 285 - DNA, 37 bp, Artificial Sequence
  SYNTHETIC
  misc_feature (19)..(20): n is a, c, g, or t
aagctgaacttccagatgnnkaccctggccagcggct

SEQ ID NO: 286 - DNA, 35 bp, Artificial Sequence
  SYNTHETIC
  misc_feature (17)..(18): n is a, c, g, or t
gaacttccagatgcccnnkctggccagcggctggg

SEQ ID NO: 287 - DNA, 33 bp, Artificial Sequence
  SYNTHETIC
  misc_feature (16)..(17): n is a, c, g, or t
ttccagatgcccaccnnkgccagcggctgggac

SEQ ID NO: 288 - DNA, 33 bp, Artificial Sequence
  SYNTHETIC
  misc_feature (16)..(17): n is a, c, g, or t
cagatgcccaccctgnnkagcggctgggacgtg

SEQ ID NO: 289 - DNA, 35 bp, Artificial Sequence
  SYNTHETIC
  misc_feature (16)..(17): n is a, c, g, or t
atgcccaccctggccnnkggctgggacgtgaacaa

SEQ ID NO: 290 - DNA, 35 bp, Artificial Sequence
  SYNTHETIC
  misc_feature (17)..(18): n is a, c, g, or t
gcccaccctggccagcnnktgggacgtgaacaaag

SEQ ID NO: 291 - DNA, 38 bp, Artificial Sequence
  SYNTHETIC
  misc_feature (18)..(19): n is a, c, g, or t
ccaccctggccagcggcnnkgacgtgaacaaagagaag

SEQ ID NO: 292 - DNA, 38 bp, Artificial Sequence
  SYNTHETIC
  misc_feature (18)..(19): n is a, c, g, or t
ccctggccagcggctggnnkgtgaacaaagagaagaac

SEQ ID NO: 293 - DNA, 40 bp, Artificial Sequence
  SYNTHETIC
  misc_feature (19)..(20): n is a, c, g, or t
ctggccagcggctgggacnnkaacaaagagaagaacaacg

SEQ ID NO: 294 - DNA, 38 bp, Artificial Sequence
  SYNTHETIC
  misc_feature (18)..(19): n is a, c, g, or t
ccagcggctgggacgtgnnkaaagagaagaacaacggc

SEQ ID NO: 295 - DNA, 37 bp, Artificial Sequence
  SYNTHETIC
  misc_feature (18)..(19): n is a, c, g, or t
gcggctgggacgtgaacnnkgagaagaacaacggcgc

SEQ ID NO: 296 - DNA, 40 bp, Artificial Sequence
  SYNTHETIC
  misc_feature (20)..(21): n is a, c, g, or t
cggctgggacgtgaacaaannkaagaacaacggcgccatc

SEQ ID NO: 297 - DNA, 41 bp, Artificial Sequence
  SYNTHETIC
  misc_feature (20)..(21): n is a, c, g, or t
ctgggacgtgaacaaagagnnkaacaacggcgccatcctgt

SEQ ID NO: 298 - DNA, 42 bp, Artificial Sequence
  SYNTHETIC
  misc_feature (21)..(22): n is a, c, g, or t
gggacgtgaacaaagagaagnnkaacggcgccatcctgttcg

SEQ ID NO: 299 - DNA, 44 bp, Artificial Sequence
  SYNTHETIC
  misc_feature (22)..(23): n is a, c, g, or t
gacgtgaacaaagagaagaacnnkggcgccatcctgttcgtgaa

SEQ ID NO: 300 - DNA, 47 bp, Artificial Sequence
  SYNTHETIC
  misc_feature (23)..(24): n is a, c, g, or t
cgtgaacaaagagaagaacaacnnkgccatcctgttcgtgaagaacg

SEQ ID NO: 301 - DNA, 47 bp, Artificial Sequence
  SYNTHETIC
  misc_feature (23)..(24): n is a, c, g, or t
gaacaaagagaagaacaacggcnnkatcctgttcgtgaagaacggac

SEQ ID NO: 302 - DNA, 41 bp, Artificial Sequence
  SYNTHETIC
  misc_feature (20)..(21): n is a, c, g, or t
agagaagaacaacggcgccnnkctgttcgtgaagaacggac

SEQ ID NO: 303 - DNA, 45 bp, Artificial Sequence
  SYNTHETIC
  misc_feature (22)..(23): n is a, c, g, or t
gagaagaacaacggcgccatcnnkttcgtgaagaacggactgtac

SEQ ID NO: 304 - DNA, 41 bp, Artificial Sequence
  SYNTHETIC
  misc_feature (20)..(21): n is a, c, g, or t
gaacaacggcgccatcctgnnkgtgaagaacggactgtact

SEQ ID NO: 305 - DNA, 41 bp, Artificial Sequence
  SYNTHETIC
  misc_feature (20)..(21): n is a, c, g, or t
caacggcgccatcctgttcnnkaagaacggactgtactacc

SEQ ID NO: 306 - DNA, 39 bp, Artificial Sequence
  SYNTHETIC
  misc_feature (19)..(20): n is a, c, g, or t
ggcgccatcctgttcgtgnnkaacggactgtactacctg

SEQ ID NO: 307 - DNA, 39 bp, Artificial Sequence
  SYNTHETIC
  misc_feature (19)..(20): n is a, c, g, or t
gccatcctgttcgtgaagnnkggactgtactacctgggc

SEQ ID NO: 308 - DNA, 45 bp, Artificial Sequence
  SYNTHETIC
  misc_feature (22)..(23): n is a, c, g, or t
gccatcctgttcgtgaagaacnnkctgtactacctgggcatcatg

SEQ ID NO: 309 - DNA, 43 bp, Artificial Sequence
  SYNTHETIC
  misc_feature (21)..(22): n is a, c, g, or t
tcctgttcgtgaagaacggannktactacctgggcatcatgcc

SEQ ID NO: 310 - DNA, 45 bp, Artificial Sequence
  SYNTHETIC
  misc_feature (22)..(23): n is a, c, g, or t
ctgttcgtgaagaacggactgnnktacctgggcatcatgcctaag

SEQ ID NO: 311 - DNA, 41 bp, Artificial Sequence
  SYNTHETIC
  misc_feature (20)..(21): n is a, c, g, or t
cgtgaagaacggactgtacnnkctgggcatcatgcctaagc

SEQ ID NO: 312 - DNA, 45 bp, Artificial Sequence
  SYNTHETIC
  misc_feature (22)..(23): n is a, c, g, or t
gtgaagaacggactgtactacnnkggcatcatgcctaagcagaag

SEQ ID NO: 313 - DNA, 45 bp, Artificial Sequence
  SYNTHETIC
  misc_feature (22)..(23): n is a, c, g, or t
aagaacggactgtactacctgnnkatcatgcctaagcagaagggc

SEQ ID NO: 314 - DNA, 39 bp, Artificial Sequence
  SYNTHETIC
  misc_feature (19)..(20): n is a, c, g, or t
ggactgtactacctgggcnnkatgcctaagcagaagggc

SEQ ID NO: 315 - DNA, 43 bp, Artificial Sequence
  SYNTHETIC
  misc_feature (21)..(22): n is a, c, g, or t
gactgtactacctgggcatcnnkcctaagcagaagggcagata

SEQ ID NO: 316 - DNA, 45 bp, Artificial Sequence
  SYNTHETIC
  misc_feature (22)..(23): n is a, c, g, or t
ctgtactacctgggcatcatgnnkaagcagaagggcagatacaag

SEQ ID NO: 317 - DNA, 41 bp, Artificial Sequence
  SYNTHETIC
  misc_feature (20)..(21): n is a, c, g, or t
ctacctgggcatcatgcctnnkcagaagggcagatacaagg

SEQ ID NO: 318 - DNA, 41 bp, Artificial Sequence
  SYNTHETIC
  misc_feature (20)..(21): n is a, c, g, or t
cctgggcatcatgcctaagnnkaagggcagatacaaggccc

SEQ ID NO: 319 - DNA, 39 bp, Artificial Sequence
  SYNTHETIC
  misc_feature (19)..(20): n is a, c, g, or t
ggcatcatgcctaagcagnnkggcagatacaaggccctg

SEQ ID NO: 320 - DNA, 45 bp, Artificial Sequence
  SYNTHETIC
  misc_feature (22)..(23): n is a, c, g, or t
ggcatcatgcctaagcagaagnnkagatacaaggccctgtccttt

SEQ ID NO: 321 - DNA, 41 bp, Artificial Sequence
  SYNTHETIC
  misc_feature (20)..(21): n is a, c, g, or t
catgcctaagcagaagggcnnktacaaggccctgtcctttg

SEQ ID NO: 322 - DNA, 41 bp, Artificial Sequence
  SYNTHETIC
  misc_feature (20)..(21): n is a, c, g, or t
gcctaagcagaagggcagannkaaggccctgtcctttgagc

SEQ ID NO: 323 - DNA, 39 bp, Artificial Sequence
  SYNTHETIC
  misc_feature (19)..(20): n is a, c, g, or t
aagcagaagggcagatacnnkgccctgtcctttgagccc

SEQ ID NO: 324 - DNA, 41 bp, Artificial Sequence
  SYNTHETIC
  misc_feature (20)..(21): n is a, c, g, or t
gcagaagggcagatacaagnnkctgtcctttgagcccaccg

SEQ ID NO: 325 - DNA, 41 bp, Artificial Sequence
  SYNTHETIC
  misc_feature (20)..(21): n is a, c, g, or t
gaagggcagatacaaggccnnktcctttgagcccaccgaaa

SEQ ID NO: 326 - DNA, 41 bp, Artificial Sequence
  SYNTHETIC
  misc_feature (20)..(21): n is a, c, g, or t
gggcagatacaaggccctgnnktttgagcccaccgaaaaga

SEQ ID NO: 327 - DNA, 39 bp, Artificial Sequence
  SYNTHETIC
  misc_feature (19)..(20): n is a, c, g, or t
agatacaaggccctgtccnnkgagcccaccgaaaagacc

SEQ ID NO: 328 - DNA, 41 bp, Artificial Sequence
  SYNTHETIC
  misc_feature (25)..(26): n is a, c, g, or t
ggcagatacaaggccctgtcctttnnkcccaccgaaaagac

SEQ ID NO: 329 - DNA, 40 bp, Artificial Sequence
  SYNTHETIC
  misc_feature (20)..(21): n is a, c, g, or t
caaggccctgtcctttgagnnkaccgaaaagaccagcgag

SEQ ID NO: 330 - DNA, 39 bp, Artificial Sequence
  SYNTHETIC
  misc_feature (19)..(20): n is a, c, g, or t
ctgtcctttgagcccaccnnkaagaccagcgagggcttt

SEQ ID NO: 331 - DNA, 37 bp, Artificial Sequence
  SYNTHETIC
  misc_feature (18)..(19): n is a, c, g, or t
ccctgtcctttgagcccnnkgaaaagaccagcgaggg

SEQ ID NO: 332 - DNA, 38 bp, Artificial Sequence
  SYNTHETIC
  misc_feature (20)..(21): n is a, c, g, or t
gtcctttgagcccaccgaannkaccagcgagggctttg

SEQ ID NO: 333 - DNA, 41 bp, Artificial Sequence
  SYNTHETIC
  misc_feature (24)..(25): n is a, c, g, or t
tgtcctttgagcccaccgaaaagnnkagcgagggctttgac

SEQ ID NO: 334 - DNA, 45 bp, Artificial Sequence
  SYNTHETIC
  misc_feature (22)..(23): n is a, c, g, or t
tttgagcccaccgaaaagaccnnkgagggctttgacaagatgtac

SEQ ID NO: 335 - DNA, 45 bp, Artificial Sequence
  SYNTHETIC
  misc_feature (22)..(23): n is a, c, g, or t
gagcccaccgaaaagaccagcnnkggctttgacaagatgtactac

SEQ ID NO: 336 - DNA, 45 bp, Artificial Sequence
  SYNTHETIC
  misc_feature (22)..(23): n is a, c, g, or t
cccaccgaaaagaccagcgagnnktttgacaagatgtactacgat

SEQ ID NO: 337 - DNA, 46 bp, Artificial Sequence
  SYNTHETIC
  misc_feature (22)..(23): n is a, c, g, or t
accgaaaagaccagcgagggcnnkgacaagatgtactacgattact

SEQ ID NO: 338 - DNA, 48 bp, Artificial Sequence
  SYNTHETIC
  misc_feature (24)..(25): n is a, c, g, or t
ccgaaaagaccagcgagggctttnnkaagatgtactacgattacttcc

SEQ ID NO: 339 - DNA, 45 bp, Artificial Sequence
  SYNTHETIC
  misc_feature (22)..(23): n is a, c, g, or t
aagaccagcgagggctttgacnnkatgtactacgattacttcccc

SEQ ID NO: 340 - DNA, 43 bp, Artificial Sequence
  SYNTHETIC
  misc_feature (21)..(22): n is a, c, g, or t
ccagcgagggctttgacaagnnktactacgattacttccccga

SEQ ID NO: 341 - DNA, 43 bp, Artificial Sequence
  SYNTHETIC
  misc_feature (21)..(22): n is a, c, g, or t
gcgagggctttgacaagatgnnktacgattacttccccgacgc

SEQ ID NO: 342 - DNA, 41 bp, Artificial Sequence
  SYNTHETIC
  misc_feature (20)..(21): n is a, c, g, or t
gggctttgacaagatgtacnnkgattacttccccgacgccg

SEQ ID NO: 343 - DNA, 44 bp, Artificial Sequence
  SYNTHETIC
  misc_feature (22)..(23): n is a, c, g, or t
ggctttgacaagatgtactacnnktacttccccgacgccgccaa

SEQ ID NO: 344 - DNA, 43 bp, Artificial Sequence
  SYNTHETIC
  misc_feature (27)..(28): n is a, c, g, or t
agggctttgacaagatgtactacgatnnkttccccgacgccgc

SEQ ID NO: 345 - DNA, 45 bp, Artificial Sequence
  SYNTHETIC
  misc_feature (27)..(28): n is a, c, g, or t
gctttgacaagatgtactacgattacnnkcccgacgccgccaaga

SEQ ID NO: 346 - DNA, 48 bp, Artificial Sequence
  SYNTHETIC
  misc_feature (28)..(29): n is a, c, g, or t
tttgacaagatgtactacgattacttcnnkgacgccgccaagatgatc

SEQ ID NO: 347 - DNA, 41 bp, Artificial Sequence
  SYNTHETIC
  misc_feature (20)..(21): n is a, c, g, or t
gtactacgattacttccccnnkgccgccaagatgatcccca

SEQ ID NO: 348 - DNA, 43 bp, Artificial Sequence
  SYNTHETIC
  misc_feature (21)..(22): n is a, c, g, or t
actacgattacttccccgacnnkgccaagatgatccccaagtg

SEQ ID NO: 349 - DNA, 41 bp, Artificial Sequence
  SYNTHETIC
  misc_feature (20)..(21): n is a, c, g, or t
cgattacttccccgacgccnnkaagatgatccccaagtgca

SEQ ID NO: 350 - DNA, 35 bp, Artificial Sequence
  SYNTHETIC
  misc_feature (17)..(18): n is a, c, g, or t
cttccccgacgccgccnnkatgatccccaagtgca

SEQ ID NO: 351 - DNA, 33 bp, Artificial Sequence
  SYNTHETIC
  misc_feature (16)..(17): n is a, c, g, or t
cccgacgccgccaagnnkatccccaagtgcagc

SEQ ID NO: 352 - DNA, 35 bp, Artificial Sequence
  SYNTHETIC
  misc_feature (17)..(18): n is a, c, g, or t
cgacgccgccaagatgnnkcccaagtgcagcaccc

SEQ ID NO: 353 - DNA, 39 bp, Artificial Sequence
  SYNTHETIC
  misc_feature (19)..(20): n is a, c, g, or t
gacgccgccaagatgatcnnkaagtgcagcacccagctg

SEQ ID NO: 354 - DNA, 37 bp, Artificial Sequence
  SYNTHETIC
  misc_feature (18)..(19): n is a, c, g, or t
ccgccaagatgatccccnnktgcagcacccagctgaa

SEQ ID NO: 355 - DNA, 39 bp, Artificial Sequence
  SYNTHETIC
  misc_feature (19)..(20): n is a, c, g, or t
gccaagatgatccccaagnnkagcacccagctgaaggcc

SEQ ID NO: 356 - DNA, 39 bp, Artificial Sequence
  SYNTHETIC
  misc_feature (19)..(20): n is a, c, g, or t
aagatgatccccaagtgcnnkacccagctgaaggccgtg

SEQ ID NO: 357 - DNA, 37 bp, Artificial Sequence
  SYNTHETIC
  misc_feature (18)..(19): n is a, c, g, or t
tgatccccaagtgcagcnnkcagctgaaggccgtgac

SEQ ID NO: 358 - DNA, 35 bp, Artificial Sequence
  SYNTHETIC
  misc_feature (17)..(18): n is a, c, g, or t
ccccaagtgcagcaccnnkctgaaggccgtgaccg

SEQ ID NO: 359 - DNA, 33 bp, Artificial Sequence
  SYNTHETIC
  misc_feature (16)..(17): n is a, c, g, or t
tgcagcacccagctgnnkgccgtgaccgcccac

SEQ ID NO: 360 - DNA, 35 bp, Artificial Sequence
  SYNTHETIC
  misc_feature (17)..(18): n is a, c, g, or t
caagtgcagcacccagnnkaaggccgtgaccgccc

SEQ ID NO: 361 - DNA, 37 bp, Artificial Sequence
  SYNTHETIC
  misc_feature (18)..(19): n is a, c, g, or t
gcagcacccagctgaagnnkgtgaccgcccactttca

SEQ ID NO: 362 - DNA, 37 bp, Artificial Sequence
  SYNTHETIC
  misc_feature (18)..(19): n is a, c, g, or t
gcacccagctgaaggccnnkaccgcccactttcagac

SEQ ID NO: 363 - DNA, 35 bp, Artificial Sequence
  SYNTHETIC
  misc_feature (17)..(18): n is a, c, g, or t
ccagctgaaggccgtgnnkgcccactttcagaccc

SEQ ID NO: 364 - DNA, 39 bp, Artificial Sequence
  SYNTHETIC
  misc_feature (19)..(20): n is a, c, g, or t
cagctgaaggccgtgaccnnkcactttcagacccacacc

SEQ ID NO: 365 - DNA, 37 bp, Artificial Sequence
  SYNTHETIC
  misc_feature (18)..(19): n is a, c, g, or t
tgaaggccgtgaccgccnnktttcagacccacaccac

SEQ ID NO: 366 - DNA, 33 bp, Artificial Sequence
  SYNTHETIC
  misc_feature (16)..(17): n is a, c, g, or t
gccgtgaccgcccacnnkcagacccacaccacc

SEQ ID NO: 367 - DNA, 36 bp, Artificial Sequence
  SYNTHETIC
  misc_feature (22)..(23): n is a, c, g, or t
aaggccgtgaccgcccactttnnkacccacaccacc

SEQ ID NO: 368 - DNA, 35 bp, Artificial Sequence
  SYNTHETIC
  misc_feature (17)..(18): n is a, c, g, or t
gaccgcccactttcagnnkcacaccacccccatcc

SEQ ID NO: 369 - DNA, 35 bp, Artificial Sequence
  SYNTHETIC
  misc_feature (17)..(18): n is a, c, g, or t
cgcccactttcagaccnnkaccacccccatcctgc

SEQ ID NO: 370 - DNA, 37 bp, Artificial Sequence
  SYNTHETIC
  misc_feature (18)..(19): n is a, c, g, or t
cccactttcagacccacnnkacccccatcctgctgag

SEQ ID NO: 371 - DNA, 39 bp, Artificial Sequence
  SYNTHETIC
  misc_feature (19)..(20): n is a, c, g, or t
cactttcagacccacaccnnkcccatcctgctgagcaac

SEQ ID NO: 372 - DNA, 45 bp, Artificial Sequence
  SYNTHETIC
  misc_feature (22)..(23): n is a, c, g, or t
cactttcagacccacaccaccnnkatcctgctgagcaacaacttc

SEQ ID NO: 373 - DNA, 39 bp, Artificial Sequence
  SYNTHETIC
  misc_feature (19)..(20): n is a, c, g, or t
cagacccacaccacccccnnkctgctgagcaacaacttc

SEQ ID NO: 374 - DNA, 41 bp, Artificial Sequence
  SYNTHETIC
  misc_feature (20)..(21): n is a, c, g, or t
gacccacaccacccccatcnnkctgagcaacaacttcatcg

SEQ ID NO: 375 - DNA, 41 bp, Artificial Sequence
  SYNTHETIC
  misc_feature (20)..(21): n is a, c, g, or t
ccacaccacccccatcctgnnkagcaacaacttcatcgagc

SEQ ID NO: 376 - DNA, 39 bp, Artificial Sequence
  SYNTHETIC
  misc_feature (19)..(20): n is a, c, g, or t
accacccccatcctgctgnnkaacaacttcatcgagccc

SEQ ID NO: 377 - DNA, 37 bp, Artificial Sequence
  SYNTHETIC
  misc_feature (18)..(19): n is a, c, g, or t
cccccatcctgctgagcnnkaacttcatcgagcccct

SEQ ID NO: 378 - DNA, 39 bp, Artificial Sequence
  SYNTHETIC
  misc_feature (19)..(20): n is a, c, g, or t
cccatcctgctgagcaacnnkttcatcgagcccctggaa

SEQ ID NO: 379 - DNA, 43 bp, Artificial Sequence
  SYNTHETIC
  misc_feature (21)..(22): n is a, c, g, or t
ccatcctgctgagcaacaacnnkatcgagcccctggaaatcac

SEQ ID NO: 380 - DNA, 41 bp, Artificial Sequence
  SYNTHETIC
  misc_feature (20)..(21): n is a, c, g, or t
cctgctgagcaacaacttcnnkgagcccctggaaatcacca

SEQ ID NO: 381 - DNA, 46 bp, Artificial Sequence
  SYNTHETIC
  misc_feature (23)..(24): n is a, c, g, or t
cctgctgagcaacaacttcatcnnkcccctggaaatcaccaaagag

SEQ ID NO: 382 - DNA, 47 bp, Artificial Sequence
  SYNTHETIC
  misc_feature (23)..(24): n is a, c, g, or t
gctgagcaacaacttcatcgagnnkctggaaatcaccaaagagatct

SEQ ID NO: 383 - DNA, 47 bp, Artificial Sequence
  SYNTHETIC
  misc_feature (23)..(24): n is a, c, g, or t
gagcaacaacttcatcgagcccnnkgaaatcaccaaagagatctacg

SEQ ID NO: 384 - DNA, 45 bp, Artificial Sequence
  SYNTHETIC
  misc_feature (22)..(23): n is a, c, g, or t
aacaacttcatcgagcccctgnnkatcaccaaagagatctacgac

SEQ ID NO: 385 - DNA, 46 bp, Artificial Sequence
  SYNTHETIC
  misc_feature (25)..(26): n is a, c, g, or t
aacaacttcatcgagcccctggaannkaccaaagagatctacgacc

SEQ ID NO: 386 - DNA, 45 bp, Artificial Sequence
  SYNTHETIC
  misc_feature (22)..(23): n is a, c, g, or t
ttcatcgagcccctggaaatcnnkaaagagatctacgacctgaac

SEQ ID NO: 387 - DNA, 41 bp, Artificial Sequence
  SYNTHETIC
  misc_feature (20)..(21): n is a, c, g, or t
cgagcccctggaaatcaccnnkgagatctacgacctgaaca

SEQ ID NO: 388 - DNA, 39 bp, Artificial Sequence
  SYNTHETIC
  misc_feature (19)..(20): n is a, c, g, or t
ctgagccacgacctgtccnnkgaagctagagcactgctg

SEQ ID NO: 389 - DNA, 35 bp, Artificial Sequence
  SYNTHETIC
  misc_feature (17)..(18): n is a, c, g, or t
ccacgacctgtccgacnnkgctagagcactgctgc

SEQ ID NO: 390 - DNA, 37 bp, Artificial Sequence
  SYNTHETIC
  misc_feature (20)..(21): n is a, c, g, or t
ccacgacctgtccgacgaannkagagcactgctgccc

SEQ ID NO: 391 - DNA, 37 bp, Artificial Sequence
  SYNTHETIC
  misc_feature (19)..(20): n is a, c, g, or t
gacctgtccgacgaagctnnkgcactgctgcccaacg

SEQ ID NO: 392 - DNA, 39 bp, Artificial Sequence
  SYNTHETIC
  misc_feature (19)..(20): n is a, c, g, or t
ctgtccgacgaagctagannkctgctgcccaacgtgatc

SEQ ID NO: 393 - DNA, 41 bp, Artificial Sequence
  SYNTHETIC
  misc_feature (20)..(21): n is a, c, g, or t
gtccgacgaagctagagcannkctgcccaacgtgatcacaa

SEQ ID NO: 394 - DNA, 43 bp, Artificial Sequence
  SYNTHETIC
  misc_feature (21)..(22): n is a, c, g, or t
ccgacgaagctagagcactgnnkcccaacgtgatcacaaaaga

SEQ ID NO: 395 - DNA, 45 bp, Artificial Sequence
  SYNTHETIC
  misc_feature (22)..(23): n is a, c, g, or t
gacgaagctagagcactgctgnnkaacgtgatcacaaaagaggtg

SEQ ID NO: 396 - DNA, 43 bp, Artificial Sequence
  SYNTHETIC
  misc_feature (21)..(22): n is a, c, g, or t
aagctagagcactgctgcccnnkgtgatcacaaaagaggtgtc

SEQ ID NO: 397 - DNA, 43 bp, Artificial Sequence
  SYNTHETIC
  misc_feature (21)..(22): n is a, c, g, or t
ctagagcactgctgcccaacnnkatcacaaaagaggtgtccca

SEQ ID NO: 398 - DNA, 39 bp, Artificial Sequence
  SYNTHETIC
  misc_feature (19)..(20): n is a, c, g, or t
gcactgctgcccaacgtgnnkacaaaagaggtgtcccac

SEQ ID NO: 399 - DNA, 39 bp, Artificial Sequence
  SYNTHETIC
  misc_feature (19)..(20): n is a, c, g, or t
ctgctgcccaacgtgatcnnkaaagaggtgtcccacgag

SEQ ID NO: 400 - DNA, 39 bp, Artificial Sequence
  SYNTHETIC
  misc_feature (19)..(20): n is a, c, g, or t
ctgcccaacgtgatcacannkgaggtgtcccacgagatc

SEQ ID NO: 401 - DNA, 43 bp, Artificial Sequence
  SYNTHETIC
  misc_feature (27)..(28): n is a, c, g, or t
cactgctgcccaacgtgatcacaaaannkgtgtcccacgagat

SEQ ID NO: 402 - DNA, 46 bp, Artificial Sequence
  SYNTHETIC
  misc_feature (23)..(24): n is a, c, g, or t
gcccaacgtgatcacaaaagagnnktcccacgagatcatcaaggac

SEQ ID NO: 403 - DNA, 45 bp, Artificial Sequence
  SYNTHETIC
  misc_feature (22)..(23): n is a, c, g, or t
aacgtgatcacaaaagaggtgnnkcacgagatcatcaaggaccgg

SEQ ID NO: 404 - DNA, 43 bp, Artificial Sequence
  SYNTHETIC
  misc_feature (21)..(22): n is a, c, g, or t
tgatcacaaaagaggtgtccnnkgagatcatcaaggaccggcg

SEQ ID NO: 405 - DNA, 41 bp, Artificial Sequence
  SYNTHETIC
  misc_feature (20)..(21): n is a, c, g, or t
cacaaaagaggtgtcccacnnkatcatcaaggaccggcggt

SEQ ID NO: 406 - DNA, 43 bp, Artificial Sequence
  SYNTHETIC
  misc_feature (21)..(22): n is a, c, g, or t
caaaagaggtgtcccacgagnnkatcaaggaccggcggtttac

SEQ ID NO: 407 - DNA, 39 bp, Artificial Sequence
  SYNTHETIC
  misc_feature (19)..(20): n is a, c, g, or t
gaggtgtcccacgagatcnnkaaggaccggcggtttacc

SEQ ID NO: 408 - DNA, 38 bp, Artificial Sequence
  SYNTHETIC
  misc_feature (19)..(20): n is a, c, g, or t
gtgtcccacgagatcatcnnkgaccggcggtttacctc

SEQ ID NO: 409 - DNA, 39 bp, Artificial Sequence
  SYNTHETIC
  misc_feature (22)..(23): n is a, c, g, or t
gtgtcccacgagatcatcaagnnkcggcggtttacctcc

SEQ ID NO: 410 - DNA, 45 bp, Artificial Sequence
  SYNTHETIC
  misc_feature (22)..(23): n is a, c, g, or t
tcccacgagatcatcaaggacnnkcggtttacctccgataagttc

SEQ ID NO: 411 - DNA, 45 bp, Artificial Sequence
  SYNTHETIC
  misc_feature (22)..(23): n is a, c, g, or t
cacgagatcatcaaggaccggnnktttacctccgataagttcttc

SEQ ID NO: 412 - DNA, 45 bp, Artificial Sequence
  SYNTHETIC
  misc_feature (22)..(23): n is a, c, g, or t
gagatcatcaaggaccggcggnnkacctccgataagttcttcttc

SEQ ID NO: 413 - DNA, 46 bp, Artificial Sequence
  SYNTHETIC
  misc_feature (26)..(27): n is a, c, g, or t
cgagatcatcaaggaccggcggtttnnktccgataagttcttcttc

SEQ ID NO: 414 - DNA, 45 bp, Artificial Sequence
  SYNTHETIC
  misc_feature (22)..(23): n is a, c, g, or t
atcaaggaccggcggtttaccnnkgataagttcttcttccacgtg

SEQ ID NO: 415 - DNA, 41 bp, Artificial Sequence
  SYNTHETIC
  misc_feature (20)..(21): n is a, c, g, or t
ggaccggcggtttacctccnnkaagttcttcttccacgtgc

SEQ ID NO: 416 - DNA, 40 bp, Artificial Sequence
  SYNTHETIC
  misc_feature (20)..(21): n is a, c, g, or t
ccggcggtttacctccgatnnkttcttcttccacgtgccc

SEQ ID NO: 417 - DNA, 43 bp, Artificial Sequence
  SYNTHETIC
  misc_feature (21)..(22): n is a, c, g, or t
ggcggtttacctccgataagnnkttcttccacgtgcccatcac

SEQ ID NO: 418 - DNA, 43 bp, Artificial Sequence
  SYNTHETIC
  misc_feature (21)..(22): n is a, c, g, or t
ggtttacctccgataagttcnnkttccacgtgcccatcaccct

SEQ ID NO: 419 - DNA, 45 bp, Artificial Sequence
  SYNTHETIC
  misc_feature (22)..(23): n is a, c, g, or t
tttacctccgataagttcttcnnkcacgtgcccatcaccctgaac

SEQ ID NO: 420 - DNA, 45 bp, Artificial Sequence
  SYNTHETIC
  misc_feature (22)..(23): n is a, c, g, or t
acctccgataagttcttcttcnnkgtgcccatcaccctgaactac

SEQ ID NO: 421 - DNA, 45 bp, Artificial Sequence
  SYNTHETIC
  misc_feature (22)..(23): n is a, c, g, or t
tccgataagttcttcttccacnnkcccatcaccctgaactaccag

SEQ ID NO: 422 - DNA, 45 bp, Artificial Sequence
  SYNTHETIC
  misc_feature (22)..(23): n is a, c, g, or t
gataagttcttcttccacgtgnnkatcaccctgaactaccaggcc

SEQ ID NO: 423 - DNA, 39 bp, Artificial Sequence
  SYNTHETIC
  misc_feature (19)..(20): n is a, c, g, or t
ttcttcttccacgtgcccnnkaccctgaactaccaggcc

SEQ ID NO: 424 - DNA, 37 bp, Artificial Sequence
  SYNTHETIC
  misc_feature (18)..(19): n is a, c, g, or t
tcttccacgtgcccatcnnkctgaactaccaggccgc

SEQ ID NO: 425 - DNA, 35 bp, Artificial Sequence
  SYNTHETIC
  misc_feature (17)..(18): n is a, c, g, or t
ccacgtgcccatcaccnnkaactaccaggccgcca

SEQ ID NO: 426 - DNA, 35 bp, Artificial Sequence
  SYNTHETIC
  misc_feature (17)..(18): n is a, c, g, or t
cgtgcccatcaccctgnnktaccaggccgccaaca

SEQ ID NO: 427 - DNA, 35 bp, Artificial Sequence
  SYNTHETIC
  misc_feature (17)..(18): n is a, c, g, or t
gcccatcaccctgaacnnkcaggccgccaacagcc

SEQ ID NO: 428 - DNA, 36 bp, Artificial Sequence
  SYNTHETIC
  misc_feature (18)..(19): n is a, c, g, or t
ccatcaccctgaactacnnkgccgccaacagcccca

SEQ ID NO: 429 - DNA, 39 bp, Artificial Sequence
  SYNTHETIC
  misc_feature (19)..(20): n is a, c, g, or t
atcaccctgaactaccagnnkgccaacagccccagcaag

SEQ ID NO: 430 - DNA, 39 bp, Artificial Sequence
  SYNTHETIC
  misc_feature (19)..(20): n is a, c, g, or t
accctgaactaccaggccnnkaacagccccagcaagttc

SEQ ID NO: 431 - DNA, 39 bp, Artificial Sequence
  SYNTHETIC
  misc_feature (19)..(20): n is a, c, g, or t
ctgaactaccaggccgccnnkagccccagcaagttcaac

SEQ ID NO: 432 - DNA, 39 bp, Artificial Sequence
  SYNTHETIC
  misc_feature (19)..(20): n is a, c, g, or t
aactaccaggccgccaacnnkcccagcaagttcaaccag

SEQ ID NO: 433 - DNA, 41 bp, Artificial Sequence
  SYNTHETIC
  misc_feature (20)..(21): n is a, c, g, or t
ctaccaggccgccaacagcnnkagcaagttcaaccagagag

SEQ ID NO: 434 - DNA, 39 bp, Artificial Sequence
  SYNTHETIC
  misc_feature (19)..(20): n is a, c, g, or t
caggccgccaacagccccnnkaagttcaaccagagagtg

SEQ ID NO: 435 - DNA, 39 bp, Artificial Sequence
  SYNTHETIC
  misc_feature (19)..(20): n is a, c, g, or t
gccgccaacagccccagcnnkttcaaccagagagtgaac

SEQ ID NO: 436 - DNA, 39 bp, Artificial Sequence
  SYNTHETIC
  misc_feature (19)..(20): n is a, c, g, or t
gccaacagccccagcaagnnkaaccagagagtgaacgcc

SEQ ID NO: 437 - DNA, 41 bp, Artificial Sequence
  SYNTHETIC
  misc_feature (20)..(21): n is a, c, g, or t
caacagccccagcaagttcnnkcagagagtgaacgcctacc

SEQ ID NO: 438 - DNA, 41 bp, Artificial Sequence
  SYNTHETIC
  misc_feature (20)..(21): n is a, c, g, or t
cagccccagcaagttcaacnnkagagtgaacgcctacctga

SEQ ID NO: 439 - DNA, 41 bp, Artificial Sequence
  SYNTHETIC
  misc_feature (20)..(21): n is a, c, g, or t
ccccagcaagttcaaccagnnkgtgaacgcctacctgaaag

SEQ ID NO: 440 - DNA, 45 bp, Artificial Sequence
  SYNTHETIC
  misc_feature (22)..(23): n is a, c, g, or t
cccagcaagttcaaccagagannkaacgcctacctgaaagagcac

SEQ ID NO: 441 - DNA, 43 bp, Artificial Sequence
  SYNTHETIC
  misc_feature (21)..(22): n is a, c, g, or t
gcaagttcaaccagagagtgnnkgcctacctgaaagagcaccc

SEQ ID NO: 442 - DNA, 45 bp, Artificial Sequence
  SYNTHETIC
  misc_feature (22)..(23): n is a, c, g, or t
aagttcaaccagagagtgaacnnktacctgaaagagcaccccgag

SEQ ID NO: 443 - DNA, 39 bp, Artificial Sequence
  SYNTHETIC
  misc_feature (19)..(20): n is a, c, g, or t
aaccagagagtgaacgccnnkctgaaagagcaccccgag

SEQ ID NO: 444 - DNA, 41 bp, Artificial Sequence
  SYNTHETIC
  misc_feature (20)..(21): n is a, c, g, or t
ccagagagtgaacgcctacnnkaaagagcaccccgagacac

SEQ ID NO: 445 - DNA, 37 bp, Artificial Sequence
  SYNTHETIC
  misc_feature (18)..(19): n is a, c, g, or t
gagtgaacgcctacctgnnkgagcaccccgagacacc

SEQ ID NO: 446 - DNA, 40 bp, Artificial Sequence
  SYNTHETIC
  misc_feature (24)..(25): n is a, c, g, or t
agagagtgaacgcctacctgaaannkcaccccgagacacc

SEQ ID NO: 447 - DNA, 41 bp, Artificial Sequence
  SYNTHETIC
  misc_feature (20)..(21): n is a, c, g, or t
gaacgcctacctgaaagagnnkcccgagacacccatcattg

SEQ ID NO: 448 - DNA, 41 bp, Artificial Sequence
  SYNTHETIC
  misc_feature (20)..(21): n is a, c, g, or t
cgcctacctgaaagagcacnnkgagacacccatcattggca

SEQ ID NO: 449 - DNA, 41 bp, Artificial Sequence
  SYNTHETIC
  misc_feature (20)..(21): n is a, c, g, or t
ctacctgaaagagcaccccnnkacacccatcattggcatcg

SEQ ID NO: 450 - DNA, 39 bp, Artificial Sequence
  SYNTHETIC
  misc_feature (19)..(20): n is a, c, g, or t
ctgaaagagcaccccgagnnkcccatcattggcatcgac

SEQ ID NO: 451 - DNA, 43 bp, Artificial Sequence
  SYNTHETIC
  misc_feature (21)..(22): n is a, c, g, or t
tgaaagagcaccccgagacannkatcattggcatcgacagagg

SEQ ID NO: 452 - DNA, 37 bp, Artificial Sequence
  SYNTHETIC
  misc_feature (18)..(19): n is a, c, g, or t
agcaccccgagacacccnnkattggcatcgacagagg

SEQ ID NO: 453 - DNA, 35 bp, Artificial Sequence
  SYNTHETIC
  misc_feature (17)..(18): n is a, c, g, or t
ccccgagacacccatcnnkggcatcgacagaggcg

SEQ ID NO: 454 - DNA, 40 bp, Artificial Sequence
  SYNTHETIC
  misc_feature (25)..(26): n is a, c, g, or t
gagcaccccgagacacccatcattnnkatcgacagaggcg

SEQ ID NO: 455 - DNA, 39 bp, Artificial Sequence
  SYNTHETIC
  misc_feature (19)..(20): n is a, c, g, or t
gagacacccatcattggcnnkgacagaggcgagcggaac

SEQ ID NO: 456 - DNA, 39 bp, Artificial Sequence
  SYNTHETIC
  misc_feature (19)..(20): n is a, c, g, or t
acacccatcattggcatcnnkagaggcgagcggaacctg

SEQ ID NO: 457 - DNA, 39 bp, Artificial Sequence
  SYNTHETIC
  misc_feature (19)..(20): n is a, c, g, or t
cccatcattggcatcgacnnkggcgagcggaacctgatc

SEQ ID NO: 458 - DNA, 45 bp, Artificial Sequence
  SYNTHETIC
  misc_feature (22)..(23): n is a, c, g, or t
cccatcattggcatcgacagannkgagcggaacctgatctacatc

SEQ ID NO: 459 - DNA, 43 bp, Artificial Sequence
  SYNTHETIC
  misc_feature (21)..(22): n is a, c, g, or t
tcattggcatcgacagaggcnnkcggaacctgatctacatcac

SEQ ID NO: 460 - DNA, 41 bp, Artificial Sequence
  SYNTHETIC
  misc_feature (20)..(21): n is a, c, g, or t
tggcatcgacagaggcgagnnkaacctgatctacatcaccg

SEQ ID NO: 461 - DNA, 39 bp, Artificial Sequence
  SYNTHETIC
  misc_feature (19)..(20): n is a, c, g, or t
atcgacagaggcgagcggnnkctgatctacatcaccgtg

SEQ ID NO: 462 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 463 - DNA, 3921 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaac

SEQ ID NO: 464 - DNA, 3921 bp, Artificial Sequence; identical to SEQ ID NO: 463
  SYNTHETIC

SEQ ID NO: 465 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQRPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFLFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 466 - DNA, 3921 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagcgtccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcctgtttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaac

SEQ ID NO: 467 - DNA, 3921 bp, Artificial Sequence; identical to SEQ ID NO: 466
  SYNTHETIC

SEQ ID NO: 468 - DNA, 3921 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagcgtccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaac

SEQ ID NO: 469 - DNA, 3921 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcctgtttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaac

SEQ ID NO: 470 - DNA, 3921 bp, Artificial Sequence; identical to SEQ ID NO: 468
  SYNTHETIC

SEQ ID NO: 471 - DNA, 3921 bp, Artificial Sequence; identical to SEQ ID NO: 469
  SYNTHETIC

SEQ ID NO: 472 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQRPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 473 - protein, 1307 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFLFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 474 - DNA, 23 bp, Artificial Sequence
  SYNTHETIC
ccgaaaaaaaaacgtaaagttgg

SEQ ID NO: 475 - protein, 7 aa, Artificial Sequence
  SYNTHETIC
PKKKRKV

SEQ ID NO: 476 - DNA, 66 bp, Artificial Sequence
  SYNTHETIC
agcagtgatgatgaagcaaccgcagatagccagcatgcagcaccgcctaaaaagaaacgtaaagtt

SEQ ID NO: 477 - protein, 22 aa, Artificial Sequence
  SYNTHETIC
SSDDEATADSQHAAPPKKKRKV

SEQ ID NO: 478 - DNA, 27 bp, Artificial Sequence
  SYNTHETIC
ccgcctccgaaacgtccgcgtctggat

SEQ ID NO: 479 - protein, 9 aa, Artificial Sequence
  SYNTHETIC
PPPKRPRLD

SEQ ID NO: 480 - DNA, 48 bp, Artificial Sequence
  SYNTHETIC
aaacgtccggcagcaaccaaaaaagcaggtcaggcaaaaaagaaaaaa

SEQ ID NO: 481 - protein, 16 aa, Artificial Sequence
  SYNTHETIC
KRPAATKKAGQAKKKK

SEQ ID NO: 482 - DNA, 57 bp, Artificial Sequence
  SYNTHETIC
aaacgtaccgcagatggtagcgaatttgaaagcccgaaaaaaaagcgtaaggtggaa

SEQ ID NO: 483 - protein, 19 aa, Artificial Sequence
  SYNTHETIC
KRTADGSEFESPKKKRKVE

SEQ ID NO: 484 - DNA, 42 bp, Artificial Sequence
  SYNTHETIC
ggtaaaccgattccgaatccgctgctgggtctggatagcacc

SEQ ID NO: 485 - protein, 14 aa, Artificial Sequence
  SYNTHETIC
GKPIPNPLLGLDST

SEQ ID NO: 486 - DNA, 18 bp, Artificial Sequence
  SYNTHETIC
caccaccaccaccaccac

SEQ ID NO: 487 - protein, 6 aa, Artificial Sequence
  SYNTHETIC
HHHHHH

SEQ ID NO: 488 - DNA, 4089 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagatgccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcttttttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccac

SEQ ID NO: 489 - DNA, 4089 bp, Artificial Sequence
  SYNTHETIC
atgacccagtttgaaggtttcaccaatctgtatcaggttagcaaaaccctgcgttttgaactgattccgcagggtaaaaccctgaaacatattcaagaacagggcttcatcgaagaggataaagcacgtaacgatcactacaaagaactgaaaccgattatcgaccgcatctataaaacctatgcagatcagtgtctgcagctggttcagctggattgggaaaatctgagcgcagcaattgatagttatcgcaaagaaaaaaccgaagaaacccgtaatgcactgattgaagaacaggcaacctatcgtaatgccatccatgattatttcattggtcgtaccgataatctgaccgatgcaattaacaaacgtcacgccgaaatctataaaggcctgtttaaagccgaactgtttaatggcaaagttctgaaacagctgggcaccgttaccaccaccgaacatgaaaatgcactgctgcgtagctttgataaattcaccacctatttcagcggcttttatgagaatcgcaaaaacgtgtttagcgcagaagatattagcaccgcaattccgcatcgtattgtgcaggataatttcccgaaattcaaagagaactgccacatttttacccgtctgattaccgcagttccgagcctgcgtgaacattttgaaaacgttaaaaaagccatcggcatctttgttagcaccagcattgaagaagtttttagcttcccgttttacaatcagctgctgacccagacccagattgatctgtataaccaactgctgggtggtattagccgtgaagcaggcaccgaaaaaatcaaaggtctgaatgaagtgctgaatctggccattcagaaaaatgatgaaaccgcacatattattgcaagcctgccgcatcgttttattccgctgttcaaacaaattctgagcgatcgtaataccctgagctttattctggaagaattcaaatccgatgaagaggtgattcagagcttttgcaaatacaaaacgctgctgcgcaatgaaaatgttctggaaactgccgaagcactgtttaacgaactgaatagcattgatctgacccacatctttatcagccacaaaaaactggaaaccatttcaagcgcactgtgtgatcattgggataccctgcgtaatgccctgtatgaacgtcgtattagcgaactgaccggtaaaattaccaaaagcgcgaaagaaaaagttcagcgcagtctgaaacatgaggatattaatctgcaagagattattagcgcagccggtaaagaactgtcagaagcatttaaacagaaaaccagcgaaattctgtcacatgcacatgcagcactggatcagccgctgccgaccaccctgaaaaaacaagaagaaaaagaaatcctgaaaagccagctggatagcctgctgggtctgtatcatctgctggactggtttgcagttgatgaaagcaatgaagttgatccggaatttagcgcacgtctgaccggcattaaactggaaatggaaccgagcctgagcttttataacaaagcccgtaattatgccaccaaaaaaccgtatagcgtcgaaaaattcaaactgaactttcagcgtccgaccctggcaagcggttgggatgttaataaagaaaaaaacaacggtgccatcctgttcgtgaaaaatggcctgtattatctgggtattatgccgaaacagaaaggtcgttataaagcgctgagctttgaaccgacggaaaaaaccagtgaaggttttgataaaatgtactacgactattttccggatgcagccaaaatgattccgaaatgtagcacccagctgaaagcagttaccgcacattttcagacccataccaccccgattctgctgagcaataactttattgaaccgctggaaatcaccaaagagatctacgatctgaataacccggaaaaagagccgaaaaaattccagaccgcatatgcaaaaaaaaccggtgatcagaaaggttatcgtgaagcgctgtgtaaatggattgatttcacccgtgattttctgagcaaatacaccaaaaccaccagtatcgatctgagcagcctgcgtccgagcagccagtataaagatctgggcgaatattatgcagaactgaatccgctgctgtatcatattagctttcagcgtattgccgagaaagaaatcatggacgcagttgaaaccggtaaactgtacctgttccagatctacaataaagattttgccaaaggccatcatggcaaaccgaatctgcataccctgtattggaccggtctgtttagccctgaaaatctggcaaaaacctcgattaaactgaatggtcaggcggaactgttttatcgtccgaaaagccgtatgaaacgtatggcacatcgtctgggtgaaaaaatgctgaacaaaaaactgaaagaccagaaaaccccgatcccggatacactgtatcaagaactgtatgattatgtgaaccatcgtctgagccatgatctgagtgatgaagcacgtgccctgctgccgaatgttattaccaaagaagttagccacgagatcattaaagatcgtcgttttaccagcgacaaattcctgtttcatgtgccgattaccctgaattatcaggcagcaaatagcccgagcaaatttaaccagcgtgttaatgcatatctgaaagaacatccagaaacgccgattattggtattgatcgtggtgaacgtaacctgatttatatcaccgttattgatagcaccggcaaaatcctggaacagcgtagcctgaataccattcagcagtttgattaccagaaaaaactggataatcgcgagaaagaacgtgttgcagcacgtcaggcatggtcagttgttggtacaattaaagacctgaaacagggttatctgagccaggttattcatgaaattgtggatctgatgattcactatcaggccgttgttgtgctggaaaacctgaattttggctttaaaagcaaacgtaccggcattgcagaaaaagcagtttatcagcagttcgagaaaatgctgattgacaaactgaattgcctggtgctgaaagattatccggctgaaaaagttggtggtgttctgaatccgtatcagctgaccgatcagtttaccagctttgcaaaaatgggcacccagagcggatttctgttttatgttccggcaccgtatacgagcaaaattgatccgctgaccggttttgttgatccgtttgtttggaaaaccatcaaaaaccatgaaagccgcaaacattttctggaaggtttcgattttctgcattacgacgttaaaacgggtgatttcatcctgcactttaaaatgaatcgcaatctgagttttcagcgtggcctgcctggttttatgcctgcatgggatattgtgtttgagaaaaacgaaacacagttcgatgcaaaaggcaccccgtttattgcaggtaaacgtattgttccggtgattgaaaatcatcgtttcaccggtcgttatcgcgatctgtatccggcaaatgaactgatcgcactgctggaagagaaaggtattgtttttcgtgatggctcaaacattctgccgaaactgctggaaaatgatgatagccatgcaattgataccatggttgcactgattcgtagcgttctgcagatgcgtaatagcaatgcagcaaccggtgaagattacattaatagtccggttcgtgatctgaatggtgtttgttttgatagccgttttcagaatccggaatggccgatggatgcagatgcaaatggtgcatatcatattgcactgaaaggacagctgctgctgaaccacctgaaagaaagcaaagatctgaaactgcaaaacggcattagcaatcaggattggctggcatatatccaagaactgcgtaacggtcgtagcagtgatgatgaagcaaccgcagatagccagcatgcagcaccgcctaaaaagaaacgtaaagttggtggtagcggtggttcaggtggtagtggcggtagtggtggctcagggggttctggtggctctggtggtagcctcgagcaccaccaccaccaccac

SEQ ID NO: 490 - DNA, 4089 bp, Artificial Sequence; identical to SEQ ID NO: 488
  SYNTHETIC

SEQ ID NO: 491 - DNA, 4089 bp, Artificial Sequence; identical to SEQ ID NO: 489
  SYNTHETIC

SEQ ID NO: 492 - protein, 1363 aa, Artificial Sequence; identical to SEQ ID NO: 23
  SYNTHETIC

SEQ ID NO: 493 - protein, 1363 aa, Artificial Sequence
  SYNTHETIC
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQRPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFLFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRNGRSSDDEATADSQHAAPPKKKRKVGGSGGSGGSGGSGGSGGSGGSGGSLEHHHHHH

SEQ ID NO: 494 - DNA, 25 bp, Artificial Sequence
  Synthetic
ttttacataaaactcttttaggtta

SEQ ID NO: 495 - DNA, 25 bp, Artificial Sequence
  Synthetic
tttcacataaaactcttttaggtta

What is claimed is:

1. A CRISPR-associated protein comprising a variant of a Cas12a, wherein the variant of the Cas12a comprises an amino acid sequence selected from the group consisting of SEQ ID NO: 472, 473 and 465.

2. The CRISPR-associated protein according to claim 1, wherein the variant of the Cas12a consists of SEQ ID NO: 472.

3. The CRISPR-associated protein according to claim 1, wherein the variant of the Cas12a consists of SEQ ID NO: 473.

4. The CRISPR-associated protein according to claim 1, wherein the variant of the Cas12a consists of SEQ ID NO: 465.

5. A CRISPR ribonucleoprotein complex, comprising:
a guide RNA; and
a CRISPR-associated protein comprising a variant of a Cas12a, wherein the variant of the Cas12a comprises an amino acid sequence selected from the group consisting of SEQ ID NO: 472, 473 and 465.

6. The CRISPR ribonucleoprotein complex of claim 5, wherein the variant of the Cas12a consists of SEQ ID NO: 472.

7. The CRISPR ribonucleoprotein complex of claim 5, wherein the variant of the Cas12a consists of SEQ ID NO: 473.

8. The CRISPR ribonucleoprotein complex of claim 5, wherein the variant of the Cas12a consists of SEQ ID NO: 465.

9. A CRISPR-associated protein comprising a variant of the Cas12a—of SEQ ID NO.: 462, wherein the variant of the Cas12a comprises an amino acid sequence selected from the group consisting of SEQ ID NO: 59-245.

10. A Cas12a polypeptide comprising an amino acid sequence selected from the group consisting of SEQ ID NO:18-22 and 24-30.

11. A CRISPR-associated protein comprising a fusion polypeptide comprising a Cas12a protein, a nuclear localization signal, optionally an amino acid linker and optionally an affinity tag,
wherein the Cas12a protein comprises an amino acid sequence selected from the group consisting of SEQ ID NO: 59-245, and
wherein the nuclear localization signal comprises an amino acid sequence selected from SEQ ID NO: 475, 477, 479, 481 and 483.

12. A CRISPR-associated protein, wherein the CRISPR-associated protein is encoded by a nucleotide sequence selected from the group consisting of SEQ ID NO: 489 and 491.

13. A CRISPR-associated protein, wherein the CRISPR-associated protein comprises SEQ ID NO: 493.

* * * * *

UNITED STATES PATENT AND TRADEMARK OFFICE
CERTIFICATE OF CORRECTION

PATENT NO. : 11,447,758 B2
APPLICATION NO. : 16/536256
DATED : September 20, 2022
INVENTOR(S) : Zhang et al.

Page 1 of 1

It is certified that error appears in the above-identified patent and that said Letters Patent is hereby corrected as shown below:

In the Claims

Column 202, Line 53, "Cas12a—of" should read -- Cas12a of --.

Signed and Sealed this
Seventeenth Day of December, 2024

Derrick Brent
*Acting Director of the United States Patent and Trademark Office*